United States Patent
Van Dun et al.

(10) Patent No.: US 10,731,174 B2
(45) Date of Patent: Aug. 4, 2020

(54) PLANTS SHOWING A REDUCED WOUND-INDUCED SURFACE DISCOLORATION

(71) Applicant: RIJK ZWAAN ZAADTEELT EN ZAADHANDEL B.V., De Lier (NL)

(72) Inventors: Cornelis Maria Petrus Van Dun, De Lier (NL); Johannes Wilhelmus Schut, De Lier (NL); Silvester De Nooijer, De Lier (NL); Johannis Hendrik De Rooij, De Lier (NL)

(73) Assignee: RIJK ZWAAN ZAADTEELT EN ZAADHANDEL B.V., De Lier (NL)

(*) Notice: Subject to any disclaimer, the term of this patent is extended or adjusted under 35 U.S.C. 154(b) by 50 days.

(21) Appl. No.: 16/106,684

(22) Filed: Aug. 21, 2018

(65) Prior Publication Data
US 2019/0136255 A1    May 9, 2019

Related U.S. Application Data

(63) Continuation-in-part of application No. PCT/EP2017/054343, filed on Feb. 24, 2017.

(30) Foreign Application Priority Data

Feb. 24, 2016 (WO) ............... PCT/EP2016/053895
Feb. 25, 2016 (WO) ............... PCT/EP2016/053999

(51) Int. Cl.
| | |
|---|---|
| *A01H 6/14* | (2018.01) |
| *C12N 15/82* | (2006.01) |
| *C12N 9/02* | (2006.01) |
| *C12N 15/01* | (2006.01) |
| *A01H 5/12* | (2018.01) |

(52) U.S. Cl.
CPC ........... *C12N 15/8271* (2013.01); *A01H 5/12* (2013.01); *A01H 6/1472* (2018.05); *C12N 15/01* (2013.01); *C12N 15/8249* (2013.01); *C12Y 114/13* (2013.01); *C12N 9/0073* (2013.01); *C12Q 2600/13* (2013.01); *C12Q 2600/158* (2013.01)

(58) Field of Classification Search
None
See application file for complete search history.

(56) References Cited

U.S. PATENT DOCUMENTS 9,814,210 B2 * 11/2017 Ammerlaan ............ A01H 5/12
2015/0282450 A1 10/2015 Ammerlaan

FOREIGN PATENT DOCUMENTS

| WO | 2007/077229 A1 | 7/2007 |
| WO | 2008/064289 A2 | 5/2008 |
| WO | 2009/007066 A2 | 1/2009 |

OTHER PUBLICATIONS

Campos-Vargas et al. Heat shock treatments delay the increase in wound-induced phenylalanine ammonia-lyase activity by altering its expression, not its induction in Romaine lettuve (*Lactuca sativa*) tissue. Physiologia Plantarum. 2005. 123:82-91.*
Atkinson et al. An intra-specific linkage map of lettuce (*Lactuca sativa*) and genetic analysis of postharvest discolouration traits. Theoretical Applied Genetics. 2013. 126:2737-2752.*
Takanori Maruta, et al., Ferulic Acid 5-Hydroxylase 1 is Essential for Expression of Anthocyanin Biosynthesis-Associated Genes and Anthocyanin Accumulation Under Photooxidative Stress in *Arabidopsis*, Plant Science (2014) vol. 219-220, p. 61-68.
Meyer, et al., Ferulate-5Hydroxylase from *Arabidopsis thaliana* Defines a New Family of Cytochrome P450-Dependent Monooxygenases, PNAS, USA (Jul. 1996) vol. 93, No. 14. p. 6869-6874.
Jun Huang, et al., Pleiotropic Changes in *Arabidopsis* f5h and sct Mutants Revealed by Large-Scale Gene Expression and Metabolite Analysis, Planta (2009) vol. 230, No. 5, p, 1057-1069.
NCBI Reference Sequence: Accession No. XP011028697: Predicted: Cytochrome P450 84A1-Like [Populus Euphratica, Jan. 6, 2015.
F. Chen, et al., Lignin Modification Improves Fermetable Sugar Yields for Biofuel Production, Nature Biotechnology (Jul. 2007) vol. 25, No. 7, p. 759-761.
Y. Jin Kim, et al., Wound-Induced Expression of the Ferulate 5-Hydroxylase Gene in Camptotheca Acuminata, Biochimica et Biophysica Acta (2006) vol. 1760, No. 2, p. 182-190.
Int'l Search Report and Written Opinion dated May 4, 2017, in Int'l Application No. PCT/EP2017/054343.

* cited by examiner

*Primary Examiner* — Ashley K Buran
(74) *Attorney, Agent, or Firm* — Duane Morris LLP; Thomas J. Kowalski; Deborah L. Lu

(57) ABSTRACT

The present invention relates a plant which may comprise a modified F5H gene homolog, wherein said gene homolog may comprise a modification as compared to its corresponding wild type F5H gene homolog, wherein the presence of the modified F5H gene homolog in the plant leads to a reduction of wound-induced surface discoloration in comparison to a plant not comprising the modified F5H gene homolog. The invention also relates to a modified F5H gene homolog that leads to the reduced wound-induced surface discoloration. The invention further relates to use of the gene in breeding and producing plants that show reduced wound-induced surface discoloration.

25 Claims, 29 Drawing Sheets
(7 of 29 Drawing Sheet(s) Filed in Color)
Specification includes a Sequence Listing.

pink pink

FIG. 4

```
SEQ ID No:27  Pear_AGR44939.1             ------MDSLL-QSLQ--PLK------SMTPLVFIPLLFL--LPLIFRFRR-----L-PPYP
SEQ ID No:22  Apple_XP_008372753.1        ------MDYLL-QSLQ--PLQ------SMTPLLLIPLLFL--LPLIFRFRR-----P-PPYP
SEQ ID No:25  Pear_XP_009378316.1         ------MDSLL-QSLQ--ALQ------SMTPLLLIPLLFL--LPLIFRFRR-----P-PPYP
SEQ ID No:26  Pear_XP_009338655.1         ------MDSLL-QSLQ--PLQ------SMTPLLLIPLLFL--LPLIFRFRR-----P-PPYP
SEQ ID No:35  Banana_XP_009403617.1       ------MDWFH-QLSF-----------MVASVFIPLALLS--FPZMRSGRK-----L-LLP
SEQ ID No:41  Rice_Os02g0113900           NANGVAEYIL-MD--------------PWLVIRLVLASMAFALLHLRRRARR-----GAPPLP
SEQ ID No:57  Onion_AC.SP3B.Locus_5396.1.10 ------MMD-----------------MQSILFTLFFVTLL--FLVTTSRRR-----PKLPLP
SEQ ID No:36  Wheat_W5AZT1                ------MATFR-KIAMELLA-------DPLMWLFLASLA---LVAMQRRRI-----GSAFFP
SEQ ID No:37  Wheat_W5AZT1                ------MAAYRK-VGTE--FLK-----DPLIWLFLASLA---FVILQRRRL-----GSAFFP
SEQ ID No:34  Banana_XP_009411495.1       ------MYWYE-EVTSMRL--------ILLCLMLRLTLL---IVNIAARRR-----RRLPLP
SEQ ID No:32  Banana_XP_009384541.1       ------MEWSE-EVTP-----------LHFMVCFALPLVL--LYVVATRRR-----GKLPFP
SEQ ID No:33  Banana_XP_009384097.1       ------MEWLE-EVTS-----------MRFVVCYVFVTLL--LAASTWRRR-----K-LPFP
SEQ ID No:42  Rice_Os10g0512400           ------MADMVK-FTME--WLQ-----DPLSLAIVVTVA---VLIMRMQRR-----RAAPPP
SEQ ID No:43  Maize_A0A0B4J2X1            ------MYTVAK-IAME--WLQ-----DPLSWVFLGTLA---LVVLQLRRR-----GKAPLP
SEQ ID No:44  Maize_B4FWF9                ------MAAAV-ANIGMEWLQ------DPLSWVFLGTVCLV--VLQQLRRRR-----VLQQLRRRR-----GKAPLP
SEQ ID No:40  Wheat_W5AC21                ------MVGLSM-IDME--WLQ-----EPLSWLFVASVI---FVILQRRRG-----KAPPLP
SEQ ID No:38  Wheat_W5B6W3                ------MVGLAK-IAMD--WLQ-----EPLSWLFVASFV---FVVLQRHRQRLRGRAPPLP
SEQ ID No:39  Wheat_A0A077RQ37            ------MVGLTK-IAME--WLQ-----DPLSWLFVASVV---FVMLRRRRR-----RGRAPPLP
```

```
Pear_XP_009338655.1        PGEKGLPLPLIGNMLLMDDLTHRGLAKLARKYGGIFHLRMGFLHMVAISSPDVARQVLQVQD
Banana_XP_009403617.1      PGPQPLPLPIGRMLMMDQLTHRGLARLAELAERYGGLFHLRLGSLHAVVVSTPEMARLVLQVQD
Rice_Os03g0112900          PGFRPLPLPIIGRMLMMDQLTHRGLARLAMAARYGGLIHLRLGRVMMVVVSSPERAREVLQVQD
Onion_AC.SP3B.Locus_5396.1.10  PGRPLPLPIIGRMLMLIDKLTHRGLAHLAMQYGGIFHLKLGSVHTFSISTPEIAREVLQTQD
Wheat_A0A077RPS5           PGFKPLPLPVIGRMTLVELTHRGLAALAKQFSGLLHLRLGRLRVYAVSTPEYAREVLHAQD
Wheat_W5AZI1               PGFKPLPLPVIGRMALVDQLTHRGLAALAKQYGGLLHLRLGRLRVYAVSTPEYAREVLAVQD
Banana_XP_009411495.1      PGFTPLPLPIGRMLLMNQLTHRGLARLARLYGGLLHLRLGFVHHFVVSTPDVARQVIQVQD
Banana_XP_009384541.1      PGFPQLPVIGRMLMMDQLTHRGLAKLGEHYGGLCHLRLGFLRAFAVSTPEIARQVIQVQD
Rice_Os10g0512400          PGFTPLPIVGRMLMMGQLTHRGLAKLSERPGGLCHLRLGFVRVFAVSTSEIARQVLQVQD
Maize_A0A0B4J2X1           PGPKPLPIVGNMRMMDQLTHRGLAALAKEYGGLMHLRLGRLRAFAVSTPEYAREVLQAQD
Maize_B4FWF9               PGFKPLPIVGNWGMMDQLTHRGLAALAETYGGLLHLRLGRLRAFAVSTPEYAREVLQAQD
Wheat_W5AC21               PGFTSPPIVGNIFMMDQLTHRGZAALAKQYGGLIHLRLGQVRAETEAVSTPEYAQQVLQAQD
Wheat_W5B6W3               PGFSPLPIVGNMFMMDQLTHRGLAALARQYGGIHLRLGQVHAVVLSTPEYAQSVLQAQD
Wheat_B0A077RQ37           PGFMPLPIVGNMSMMDQLTHRGLFTALAKKYGGFLHLRLGRVHAFAVSTPEYAQSVLQVQD
                           ***  *:.**     .*:**:  ::  .::*:    :*   .   :*    ::
```

```
Pear_XP_009338655.1       NIFSNRPATIAISYLITYDRADMAFAHYGPFWRQMRKLCVMKLFSRKRAESWESVRDSVDS
Banana_XP_009403617.1     ASFCNRPVTAAIAYLTYDRADNAFANYGPFWRQTRKLCVMKLFSKRRLQSWASVRQEVDS
Rice_Os03g0112900         GDFSNRPASIAIAYLTYGRADNAFSRYGRFWRQVRKLSAVRLFSRKRAQSWRAVRDESAK
Onion_AC.SP3B.Locus_5396.1.10 LAFSNRPATIAITYLITYDKADMAFTHYGPFWRQIRKLCVMKLFSRKRAESWASVREEIEK
Wheat_A0A077RPS5          GVFSNRPATIAVVYLTYGRSDMAFAHMGAYWRQMRKLCVTKIFSRRAETWLAVREGYGA
Wheat_W5A2I1              AALSNRPATIAVVYLTYGRSDMAFAHMGAYWRQMRKLCVTKLFSRRAETWLAVREGYGA
Banana_XP_009411495.1     SVFSDRPATTAIVYLTVNRSDIAFAQCGPYWRQMRKLCVTKLFSRKHAESWLSIPEEVDA
Banana_XP_009384541.1     NVFSRRPATIAISYLTYWRADMAFAHYGPFWRQMRKLCVMKLFSKKRAESWASVREEVDV
Banana_XP_009384087.1     AVFSNRFATIATTYLTYDRADMAFAHYGPFWRQMRKLCVMKLPSKKRAVSWASVREEVDA
Rice_Os10g0512400         GAFSNRPATTAIAVLTYDRADMAFAHYGPFWRQMRKLCVYKLFSRRRAETWLAVRDESAA
Maize_A0A0B4J2X1          GAFSNRPATIAIAYLTYDRADMAFAHYGPFWRQMRKLCVVKLFSRRAETWVAVRDECAA
Maize_B4FWF9              GAFSNRPATAAIAYLTYDRADMAFAHYGPFWRQMRKLCVMKLFSRRAETWAAVRDECAA
Wheat_W5AC21              AAFSNRPATIATTYLTYDRADMVFAHYGPFWRQMRKLCVMKLFSRRPGTWLAVRDESAA
Wheat_W5B6W3              VAFSNRPATVAAIYLTTDRADWAFAHYGPFWRQMRKLCVMKLFSRRKAGTWLAVREESAA
Wheat_A0A077RQ37          AAFSNRPASLAATILTYDRADMHFAHEGPFWRQMRKLCVMKLFSRRKPETWLAVRNESAA
                            *   *   :*        *  *  :: :  *   ** ***       : :*    ::
```

FIG. 4 continued

| Sequence ID | Sequence |
|---|---|
| Celery_R2_draft_99.605_EVM363634 | MLRGVAS----R-ARQ-AVNLGELVPGFTEKIIYRAAFG----SRLSDGG-Y-EFIRMQEF |
| Brassica_XP_013607401.1 | AVRSVAA----R-VGK-PLNVCKVAFSLIRDITRAAFGSSSSSNEGRLD-EFLRIIQEF |
| Radish_rs_Aokubi_v1_EVM13601 | AVRFVAA----N-VGK-PLNICKVAFSLTRDITFGAAFGSSSSTSDEGRLD-EFLRIIQEF |
| Brassica_Bo7g119430 | MVQTLTK----Q-TGS-PVNVGELVFALTRNITYRAAFG----SFARDGG-D-EFVKILQEF |
| Radish_GSBRAST00042054001 | MVQTLTK----Q-TGS-PVNVGELVFALTRNITYRAAFG----SFARDGG-D-EFVKILQEF |
| Peach_XP_007199246.1 | MVRHVAT----K-TSS-PVNIGGLVFTLTRNITYRAAFG----SSSHBGG-G-EFVKILQEF |
| Apple_XP_008391587.1 | MVQTVAG----K-TGS-PVNIGGLVFALTRNITYRAAFG----SSSHBGQ-G-EFVQILQEF |
| Pear_XP_009378429.1 | MVQTVAG----R-TGS-PVNIGGLVFVARMITYRAAFG----SRSHBGQ-G-EFVKILQEF |
| Eggplant_sm_57_3_v1_EVM112833.1 | MTMAVAT----R-TGS-SVNIGELVFGVARMITYRAAFG----TCSNRGQ-D-ELNMMQEF |
| Celery_R2_draft_99.605_EVM348724 | BLGKVVS----N-SGL-SVNIGELVFGLTRNITYRAAFG----SISGQGQ-D-EFTKMQEF |
| Celery_c17480_gi_iim_26831 | MKIVLS----K-TGC-SVNIGELVFGLTRNITYRAAFG----TLSHEGQ-D-EFTKILQEF |
| Artichoke_KVI02897.1 | MKITAA----S-SGS-AVNIGELVFGLTHDIIYRAAFG----SISHEGK-E-EFIKILQEY |
| Lettuce_LsF5H_2_1 | MKITAA----S-SGT-AVNIGELVFGLTHDIIYRAAFG----SISHEGK-E-EFIKILQEY |
| Endive_ce_kethel_v0.1_EVM71979 | MKITAA----S-SGS-AVNIGELVFGLTHDIIYRAAFG----SISHEGK-E-EFIRILQEY |
| Chicory_ci_vitessa_fr_v1_EVM1685 | MKITAA----S-SGS-AVNIGELVFGLTHDIIYRAAFG----SISHBGK-E-EFIRILQEY |
| Artichoke_KVH92322.1 | MVTTAT----R-SGL-PVNLGELVFGLTHDIIYRAAFG----STSHEGK-E-EFIRILQEY |
| Lettuce_LsF5H_1_1 | MVKATAI----R-SGT-PVNLGELVFGLTHDIIYRAAFG----SISHEGK-E-EFIRILQEY |
| Endive_ce_gene1 | MVKATAT----R-SGL-PVNLGELVFGLTHDIIYRAAFG----SISHEGK-E-EFIRILQEY |
| Chicory_ci_vitessa_fr_v1_EVM1707 | MVKATAT----N-SGL-PVNLGELVFGLTHDIIYRAAFG----SISHEGK-E-EFIRILQEY |
| Endive_ce_gene2 | MVKATAI----N-SGL-PVNLGELVFGLTHDIIYRAAFG----SISHBGK-E-EFTRILQEY |
| Chicory_ci_vitessa_fr_v1_EVM1707 | MVKATAI----N-SGL-PVNLGELIFTLTRNITYRAAFG----SISHBGK-E-EFIRILQEY |
| Brassica_Bo3g093960 | MVRSFSS----N-VGK-PVNLGELIFTLTRNITYRAAFG----AACETEQ-D-EFIRILQEP |
| Radish_GSBRAST00001088001 | MVRSLSS----N-DVGK-PVNVGDLIFFLTRNITYRAAFG----AACETEQ-D-EFIRILQEP |
| Brassica_Bo7g117840 | MIRSVSS----N-VGK-SINVGKQIFAIRMIYRAAFG----SACEKGQ-D-EFIRILQBP |
| Radish_GSBRAST00007419001 | MIRSVSS----N-VGK-SIRVGKQIFAITRNITYRAAFG----SACEKGQ-D-EFIRILQBP |
| Brassica_Bo1g005770 | MIRSVSS----N-VGK-SIRVGEQIFAITRNITYRAAFG----SACEKGQ-D-EFIRILQBP |
| Radish_GSBRAST00026355001 | MIRSVSN----N-VGK-SIRVGEQIFALTRNITYRAAFG----BACEKGQ-D-EFIRILQBP |
| Eggplant_c18735_gi_iim_19489 | LIKIVTT----N-AGT-SVNLGELVFGLTRNITYRAAFG----TSSAEGQ-E-EFIKILQBP |
| Potato_XP_006340697.1 | MKIVTT----N-TGT-SINLGELVFCLTRNITYRAAFG----TSSDEGQ-D-DFIKILQBP |
| Soybean_R7MH28 | ILKSVTN----R-VGK-LGS-PVRNVGELVFNLTRNIIYRAAFG----SSSQEBGQ-D-EFIGILQEF |
| Soybean_G3E7M3 | AVRAVAS----S-VGK-PVNIGELVFNLCRKIIYRAAFG----SSSQEBGQ-D-EFIKILOEF |
| Soybean_I1J9P0 | AVRAVAS----S-VGK-PVNIGELVFNLCRKIIYRAAFG----SSSQEBGQ-D-EFIKILOEF |
| Soybean_I1LRY5 | AVRAVAN----S-VGK-PVNIGELVFNLTRNIIYRAAFG----SSSQEBGQ-D-EFIKILOEF |
| Soybean_Q2LAL3 | AVRAVAS----S-VGK-PVNIGELVFNLTRNIIYRAAFG----SSSQEBGQ-D-EFIKILOEF |
| Peach_XP_007203643.1 | AVRTVAV----Q-AGS-AVNIGBLVFSLTRNIIYRAAFG----TSSEBGQ-D-EFIGILOEF |
| Apple_XP_008337913.1 | AVRTVTV----R-VGS-AVNIGELVFSLTRNIIYRAAFG----TSSEBGQ-D-EPIGILOEF |
| Pear_XP_009346304.1 | AVRTVTV----R-VGS-AVNIGELVFSLTRNIIYRAAFG----TSSQBGQ-D-EPIAILOEF |
| Pear_AGR44939.1 | AVRTVTV----R-VGS-AVNIGELVFSLTRNIIYRAAFG----TSSQBGQ-D-EPIGILOEF |
| Apple_XP_008372753.1 | SVRTVTV----R-VGS-AVNIGEHVFSLTRNIIYRAAFG----TSSQBGQ-D-EPIGILOEF |
| Pear_XP_009378215.1 | AVRTVTV----R-VGS-AVNIGEHVFSLTRNIIYRAAFG----TSSQBGQ-D-EPIGILOEF |

FIG. 4 continued

```
Pear_XP_009330655.1      AVRTVTV----R-VGS-AVNIGELVFSLTKRITYRAAFG----TSSQEGQ-D-EFIGILQEF
Banana_XP_009403617.1    AVRFAAR----R-SGS-SVDVGDLAFTLAKRVTFMAAFG----AQSMGRQ-G-EFAGILQEY
Rice_Os03g0112900        LVGAIAR----R-AGE-AVDLGELIFGLTKGVIFRAAFG----TRDGGGH-G-ELEVILQEF
Onion_AC.5P3B.Locus_5396.1.10  AVSTAAA----G-AGT-VVWVGELVFNLTKRITFRAAFG----AKSGEEQ-D-EFLGILQEI
Wheat_A0A077RPS5         LAKEVGR----R-SGE-AVNLGELFNLTVSVIFRAAFS----TCDEDGL-I-EFIAILQEF
Wheat_W5AZT1             LACAVSR----R-CGE-AVNLGELFNLTVSVIFRAAFS----TRDEDGL-D-EFIAILQEF
Banana_XP_009411495.1    AVCTVAK----R-AGS-AFNVRDLAFTLDNRIVFRSAFG----KRSDENQ-E-EYIAVVQEI
Banana_XP_009394541.1    AVRSLAD----R-AGS-AVNVGELAFNLRNIIFRAAFG----SQSHENQ-M-EFISILQEF
Rice_Os10g0512400        AVRAVTD----G-AGA-AVNLGELMFNLRNITFRAAFG----TQSHEMQ-B-EFIAILQEF
Maize_A0A0B4J2X1         LVRAVAS----S-RGEAAVNLGELIFNLTKRVIFRAAFG----TRDGEGH-D-EFIAILQEF
Maize_B4FWF9             LVRAVASGGGG-GGE-AVNLGELIFSLJRNVTFRAAFG----TRDGEDQ-E-EFIAILQEF
Wheat_W5AC21             LVRAVAVGGGS-GGE-AVNLGELIFSLJRNVTFRAAFG----TRDGSGQ-E-EFIAILQEF
Wheat_W5B6W3             LVRAVAR----R-SGE-FVNLGDLIFRLSMNVTFRAAFGADAAGDGRAQHEFIAIMQEF
Wheat_W5B6W3             LVRAVAR----R-SGE-SVNLGELIFNLRNVTFRAAFG-ADAAGDAGKRD-EFIAIMQEF
Wheat_A0A077RQ37         LVRAVAR----R-SGE-TVNLGELIFNLARNVTFRAAFG-AGAAGDAGKQS-EFIAILQEF
                                          :  : * :  :   ;   .  ***          ;  :*** 
```

```
Pear_XP_009338655.1       SKLFGAPNIADFIP--GLGWVDPQGINNRLAKARESLDKFIDTIIDDHEKNRNGKGV-SD
Banana_XP_009403617.1     SKLFGEFNISDFLP--WLRMDLQGIDKRLKVARQAIDKYIDVIIDDHLANPKE-ADA---
Rice_Os03g0112900         SKLFGAPNVGDFIP--WLAWLDPAGINRRLRAARAALDSVIDRIIEEHVSNP---AGD---
Onion_AC.SPIB.Locus_5396.1.10  SKILFGAPNVGDFVP--GLRYLDPQGIGRAMKVRKELDGFIDRIIEEHVQRKE-VDD---
Wheat_A0A077RPS5          SWLLGLFHIGDFFP--WLAWVGRRGFNRRLSTARGALDRFIDKIVEEHMRRGKD-PAD---
Wheat_W5A2I1              SGLLGLFHIGDFFP--WLGWVGRRGFNRRLRTARGALDKFIDRIIDEHMRGKN-AAD---
Banana_XP_009411495.1     ATLLGAFSVGDFIP--WLSRMDFKAGINKRLKVARATLDLFIDRIIDEHMA----FDA---
Banana_XP_009384541.1     SKLFGSFNIGDFIP--WLSRMDFKAGINKRLKVARAGLDRFIDKIIDEHMANRKE-ADA---
Rice_Os10g0512400         SLLFGAPNIGDFIP--WVSRMDLQGINKRFKVAREALDGFIDKIIEEHMAANPKE-ADA---
Maize_A0A0B4J2K1          SKLFGAPNIGDFTP--WLSRMDLQGINAKLVAARTALDRFIDKIIDEHMRRGKN-PDD---
Maize_B4FKF9              SKLFGAPNVYDFLP--WLSRMDLQGINRRLRAARSALDRFIDKIIDEHVRGKN-PDD---
Wheat_W5AC21              SKLFGAPSIGDFIP--WLGWADPQGIKVFLPAARTALDEFIDKIIDEHIKRGKN-PDD---
Wheat_W5B6M3              SQLFGGSIGDFIP--WLGWVD-QGLNVRARTARAALDSFIDKIIDEHMRRGKN-PDD---
Wheat_A0A077RQ37          SKLFVEFCIGDFIP--WLSRADFQGINVFLRAARAALDQFIDKIIDEHMKRGRN-PDD---
                          :.*: .:  **: *    *  * :  :*. :  *:  *:  *:**  :*: ::: *:
```

FIG. 4 continued

```
Celery_R2_draft_99.605_EVM13634      ------GDKDMVDELLAFYTEEGAK-----------AESDD--LQATIKLTRNMIKGIIMDI
Brassica_XP_013607401.1              D------EVTDMVDQLLAFYKEEVAV----------KDSET--------KIRLLDRIKGIIMDV
Radish_rs_Aokubi_v1_EVM13601         D------EETDMVDQLLAFYKEEVAV----------KDSET--------KIRLLNRIKGIIMDV
Brassica_B07g119430                  ---------LEDDMVDELMAFYSGESGENG------GKSND--SLSSFKLTRDNIKALVMDV
Radish_GSBRAST00042054001            DG------LEDDMVDELMAFYSGENG----------GKSND--SLSTFRLTRDNIKALVMDV
Peach_XP_007199246.1                 DDEEAETDMVDELIAFFSDDAA--------------KESDD--FNSTFRLTRDNIKAIIMDV
Apple_XP_008391587.1                 DSEAADTDMVDELIAYFSDDAG--------------KEGDD--PNSGFKLTRDNIKAIIMDV
Pear_XP_009379429.1                  DSEAADTDMVDELLAYFSDDAG--------------KEGDD--PNSGFKLTRDNIKAIIMDV
EggPlant_sm_67_3_v1_EVM112873.1      RGM----MRDMVDELLAFYGEKTKL-----------NHSDD--LTMAIRLTRDNIKSIIMDI
Celery_R2_draft_99.605_EVM34872#     TDE-GNGDMVYQLLAFYSEEQSKV------------NHSDD--TMNALKLTRDNIKAIIMDV
Celery_c17480_gl_ilm_36831           IDE-GNSDMVYELLDFYGEEKARV------------SEFED--QNSSLKLTRDNIKAIIMDV
Artichoke_KV1102897.1                ------DNDMVDEMLAFYSEEGKV------------NEGED--LQNAIRLTRNNIKAIIMDV
Lettuce_LsF5H_2.1                    ------DNDMVDEMLAFYSEEGKV------------NEGED--LQNAIRLTRNNIKAIIMDV
Endive_ce_kethel_v0.1_EVM71979       ------DNDRNVDEMLAFYSEEGKV-----------NEGED--LQNAIRLTRNNIKAIIMDV
Chicory_ci_vitessa_fr_v1_EVM1585     ------DNDMVDEMLAFYSEEGKV-----------NEGED--LQNAIRLTRNNIKAIIMDV
Artichoke_KVH92322.1                 ------VNDMVDEMLAFYSEEGKT-----------NEAED--LQNAINLTRDNIKAIIMDV
Lettuce_LsF5H_1.1                    ------LDNDMVDEMLAFYSEDGKV-----------NEGGD--LQNAINLTRDNIKAIIMDV
Endive_ce_gene1                      ------VDNDMVDEMLAFYSEDGRI-----------NEGGD--LQNAINLTRDNIKAIIMDV
Chicory_ci_vitessa_fr_v1_EVM1707     ------VDNDMVDEMLAFYSEDGRV-----------BEGGD--LQNAIKLTRDNIKAIIMDV
Endive_ce_gene3                      ------VDNDMVDEMLAFYSEDGRV-----------MEGGD--LQNAIKLTRDNIKAIIMDV
Chicory_ci_vitessa_fr_v1_EVM1707     ------VDNDMVDEMLAFYSEDGRV-----------MEGGD--LQNAIKLTRDNIKALMDV
Brassica_B03g093960                  --------EDTDMVDDLLAFYSEDSST---------NRMKN------TVKLTRDNIKALVMDV
Radish_GSBRAST00001088001            --------EDTDMVDDLLAFYSEDSSP---------NRSKN------AVKLTRDNIKALMDV
Brassica_B07g117840                  DGYVGDTDMVDDLLAFYSEEAKLV------------SETTD--LQNSIKLTRDNIKAIIMDV
Radish_GSBRAST00007419001            DGD-VDTDMVDDLLAFYSEEAKLV------------SETTD--LQNSIKLTRDNIKAIIMDV
Brassica_B01g005770                  AGRVVDTDMVDDLLAFYSEEAKLV------------SETAD--LQNSIKLTRDNIKAIIMDV
Radish_GSBRAST00026355001            DGEVVDTDMVDDLLAFYSEEAKLV------------SEATE--LQNSIKLTRDNIKAIIMDV
Eggplant_c18725_gl_i1m.19489         NGD-RETDMVDELLAFYSEETKV-------------NESEDNLQNAIRLTRDNIKAIIMDV
Potato_XP_006340697.1                DGY-RESDMVDELLAFYSEETKV-------------NESED--LQNSIRLTRDNIKAIIMDV
Soybean_K7MH29                       --------EESDMVDELINFYSREAKLN--------DESEE--LLNSISITRDNIKAIIMDV
Soybean_G8B7M3                       IVD-GETDMVDDLLAFYSEAKLN-------------NESDD--LQMSIRLTKDNIKAIIMDV
Soybean_I1J8P0                       IVD-GETDMVDELLAFYSEEAKLN------------NESDD--LQMSIRLTKDNIKAIIMDV
Soybean_I1LAY5                       IGD-GETDMVDELLAFYSEEAKLN------------NESDMLQNSIRLTKDNIKAIIMDV
Soybean_Q2LAL3                       IVD-GETDMVDELLAFYSEEAKLN------------NESDMLQNSIRLTKDNIKAIIMDV
Peach_XP_007203643.1                 SMG-GETDMVDELLAFYSDEAKV-------------NESDDMLQMAINLTRDNIKAIIMDV
Apple_XP_008337913.1                 --------GETDMVDDLLAFYSEEAKV---------NESEDMLQMAIKLTRDNIKAIIMDV
Pear_XP_009346304.1                  --------NESEDMLQMAIKLTRDNIKAIIMDV
Pear_AGR44939.1                      D-----GETDMVDDLLAFYSEEAKV-----------NESEDMLQSAIKLTRDNIKAIIMDV
Apple_XP_008372753.1                 --------GETDMVDELLAFYSEEAKV---------VESEDNLQNAIKLTRDNIKAIIMDV
Pear_XP_009378215.1                  --------SETDMVDELLAFYSEEAKV---------NESEDMLQSAIKLTRDNIKAIIMDV
```

FIG. 4 continued

```
Pear_XP_009338655.1         -------SETDMVDELLAFYSEEARV--------------------NESEDNLQSAIKLTRDNIKAIIMDV
Banana_XP_009403617.1       -------QDADMVDGMLAFIGDSGDT--------------------NEGGD-LKGDLSLTRSNIKAIIMDV
Rice_Os03g0112900           -------EDADMVDDMLAFLDEAGRDQT------------------GGGGE-LQGTIRLTRDNIKAIIMDF
Onion_AC.SP3B.Locus_5396.1.10  ----VEADMVDEMLAFVGGGKEIG-------------------RDSDE------LRLTRANIKAIIMDV
Wheat_A0A077RPS5            -------PGADLVDGLLGFLADA-----------------------MPRED-----AIRFTRDNVKAMIMDM
Wheat_W5A2I1                -------PEADLVDGLLAFLAEANPI--------------------SGKH-REDAIRFTRDNAKAMIMDM
Banana_XP_009411495.1       -------ANADMVGVMLAFIEESSSHHRQ-----------------EAGDD-LKGTLRLSRANIRAVMMDV
Banana_XP_009384541.1       -------SDADMVDDMLAFLGESGTFKQD-----------------GERDD-LQGTLKITRRNIRAIIMDV
Banana_XP_009384087.1       -------EDSDMVDEMLAFTEESRDRTKE-----------------MEADE-LQRTLRITRANIKAIIMDV
Rice_Os10g0512400           -------ADADMVDDMLAFLABAKPHAGKAAAAAGAGDGADD-LQMTIRLTRDNIKAIIMDV
Maize_A0A0B4J2K1            -------ADADMVDDMLAFLABAKPKKGPAAA---------------ADGDD-LHNTLRLTRDNIKAIIMDV
Maize_B4FWF9                -------ADADMVDDMLAFFVEATPGKAYGAAAAA------------DGGDD-LHNTLRLTRDNIKAIIMDV
Wheat_W5AC21                -------MBADMVDGMLAFIPEAKPDK--------------------AAGDD-LHHTLRLNRDNIKAIIMDV
Wheat_W5B6W3                -------VDADMVDDMLAFLPEAKPKK--------------------DAGDD-LQNSLHLTRDNIKAMIMDV
Wheat_A0A077RQ37            -------VDADMVDDMLAFLPEARTKKRAAG----------------DRGDD-LQMTLRLTRDNIKAMIMDV
                                   *.*    ::::                                :         :.:**.
```

FIG. 4 continued

| Name | Sequence |
|---|---|
| Celery_R2_draft_99.605_EVM363634 | MFGGTETVAAAIEWAMSELLRNPEELRKTQEELSRVVGLNR--CVEEGDLEKLTYLKCVIK |
| Brassica_XP_013607401.1 | MFGGTETVALAIEWVLTELLRSPENMKRVQDELATVVGLERMSVEDTHLSKLSFLKCVLK |
| Radish_rs_Aokubi_v1_EVM13601 | MFGGTETVALAIEWVLTELLRSPENMKRVQEELATVVGLERMSVEDTHLEKLTFLKCVLK |
| Brassica_Bo7g119430 | MFGGTETVASAIEWAMTELMKNFHELVKLQQELADVIGLNR--EFHESDLEMLPYFRCAMK |
| Radish_GSRAST00042054001 | MFGGTETVASAIEWAMTELMKNFHELVKLQQELADVIGLNR--QFHESDLEMLPYFRCAMK |
| Peach_XP_007199246.1 | MFGGTETVASVIEWTMAELMKSPEHLQKVQQELINVVGLNR--RVQETDLEKLTYLKCAVK |
| Apple_XP_008391587.1 | MFGGTETVASVIEWTMAELMKSPEDLKRVQQELTDVVGLNR--RLQETDLEKLTYLKCAVK |
| Pear_XP_009378429.1 | MFGGTETVASVIEWTMAELMKSPEDLKRVQQELTDVVGLAR--RLQETDLEKLTYLKCAVK |
| Eggplant_sm_67_3_v1_EVM112823.1 | MFGATETVASAIEWAMAELMKSPEDLKRVQQELANVVGLAR--RVEEMDFEKLIFLKCCIK |
| Celery_R2_draft_99.605_EVM348724 | MFGGTETVASAIEWAMSELMGSPEDLKRVQELIDVVGLAR--RVEENDFDMLIYLKCCIK |
| Celery_c17480_g1_i1m.26831 | MFGGTETVASAIEWAMSELMRSPKDLKRVQELKEVVGELAK--RVEESDFDKLTYLKCCIK |
| Artichoke_KVI02897.1 | MFGGTETVASAIEWALTELMHTPEALKRAQQELADVVGLDR--RVEESDFEKLTYFKCIIH |
| Lettuce_LsF5H_2_1 | MFGGTETVASAIEWALTELMHTPESLKRAQQELADVVGLDR--RVEESDFEKLTYFKCVIK |
| Endive_ce_kethel_v0.1_EVM71979 | MFGGTETVASAIEWALTELMHTPESLKRAQQRLVDVVGLDR--RVEESDFEKLTYRCVIK |
| Chicory_ci_vitessa_fr_v1_BVM1585 | MFGGTETVASAIEWALTELMHTPESLKRAQQELADVVGLDR--RVEESDFEKLTYRCVIK |
| Artichoke_KVH92322.1 | MFGGTETVASAIEWAMTELMHTPEALKLVQEELTNVVGLDR--RVEESDFEKLPYKCVIK |
| Lettuce_LsF5H_1_1 | MFGGTETVASAIEWAMTELMHTPEALKRVQQEMANVVGLDR--RVEESDLEKLTYEKCVIK |
| Endive_ce_gene1 | MFGGTETVASAIEWTMTELMHTPEALKRVQQELTNVVGLDR--RVEESDFEKLTYEKCVIK |
| Chicory_ci_vitessa_fr_v1_EVM1707 | MFGGTETVASAIEWTMTELMHTPEALKRVQQELTNVVGLDR--RVEESDFEKLTYEKCVIK |
| Endive_ce_gene2 | MFGGTETVASAIEWTMTELMHTPEALKRVQQELTNVVGLDR--RVEESDFEKLTYRCVIK |
| Chicory_ci_vitessa_fr_v1_EVM1707 | MFGGTETVASAIEWTMTELMHTPEALKRPQELTNVVGLDR--RVEESDFEKLTYRCVIK |
| Brassica_B03g093960 | MFGGTETVASAIEWALTELLRRPAELMKSPEDLKRVQELTEVVGLDR--RVDTHLEQLTFLKCTLK |
| Radish_GSRAST00001088001 | MFGGTETVASGIEWALTELLRRPAELMKRLQQELTEVVGLDQ--RVDTHLEKLTFLKCTLK |
| Brassica_Bo7g117840 | MFGGTETVASAIEWALTELLRSPEDLMKRVQQELAEVVGLDR--RVEESDIEKLTFLKCTLK |
| Radish_GSRAST00007419001 | MFGGTETVASAIEWALTELLRSPEDLKRVQQELAEVVGLDR--RVEESDIEKLTLMCTLK |
| Brassica_Bo1g005770 | MEGGTETVASAIEWALTELLRSPEDLKRVQQELAEVVGLDR--RVEESDIEKLTLMCTLK |
| Radish_GSRAST00026355001 | MFGGTETVASAIEWALTELLKSPEDLKRVQQELAEVVGLDR--RVEESDIEKLTFLKCTLK |
| Eggplant_c18725_g1_i1m.19489 | MFGGTETVASAIEWVMAELVKNPEELKRVQELANVVGLNR--RVEESDLEKLTYLKCCLK |
| Potato_XP_006340697.1 | MFGGTETVASAIEWVNSELMKSPEDLKRVQQELAMVVGLMR--RVDSSDFEKLTYLKCCLK |
| Soybean_K7MH28 | MFGGTETVASGIEWAMAELMKSPDDLRRVQQRIADVVGLDR--RVEESDLEKLVYLKCAVK |
| Soybean_G3E7M3 | MFGGTETVASAIEWAMAELMRSPEDQRRVQQELADVVGLDR--RAEESDFEKLTYLKCAIK |
| Soybean_I1J8P0 | MFGGTETVASAIEWAMAELMRSPEDORRVQQELADVVGLDR--RAEESDFEKLTYLKCAIK |
| Soybean_I1LHY5 | MFGGTETVASAIEWVMSELMRSPEDQRRVQELADVVGLDR--RVEESDFEKLTYLKCALK |
| Soybean_Q2LAL3 | MFGGTETVASAIEWAMAELMRSPEDQKRVQELADVVGLDR--RAEESDFEKLTYLKCAVK |
| Peach_XP_007203643.1 | MFGGTETVASAIEWAMAELMKNPEILKRVQELIADVVGLDR--RPEEGDFEKLTYLKCALK |
| Apple_XP_008337913.1 | MFGGTETVASAIEWAMSELMKNPEDLKRVQEILMVVGLDR--RPEEADFEKLTYLKCALK |
| Pear_XP_009346304.1 | MFGGTETVASAIEWAMSELMKSPEDLKRVQELRNVVGLDR--RPEEADFEKLTVLKCALK |
| Pear_AGR44939.1 | MFGGTETVASAIEWAMSELMKSPEDLKRVQELADVVGLDR--RPEETDFEKLTYLKCALK |
| Apple_XP_008372753.1 | MFGGIXTVASAIEWAMSELMKSPEDLRVQELADVVGLDR--RPEETDFEKLTYLKCALK |
| Pear_XP_009378215.1 | MFGGTETVASAIEWAMSELMKSPEDLKRVQELADVVGLDR--RPEETDFEKLTTLKCALK |

FIG. 6 continued

| Pear_XP_009338655.1 | MFGGTETVASAIEWANSELMKSFEDLKRVQQELADVVGLDR-RPEETDFEKLTYLKCAIK |
| Banana_XP_009403617.1 | MFGGTETVAIGIEWANAELLKSFEKLKRTQQELASVVGLHR-KVDDSDLDKLFYLKCAVK |
| Rice_Os03g0112900 | VFGGTETVASAIEWANRELLASPGDLRRLQAELADVVGLGR-GVEEGDLEKLPFLRCVAM |
| Onion_AC.sp38.Locus_5396.1.10 | MFGGPETVASAIEWAMAELLKSFEDLKRLQQEITSVVGLDR-KVQDSDLDKLPFLKCVIK |
| Wheat_A0A077RPS5 | LFGGPETVGSTTEWAMAENMRSPDELERLQQELADVVGLDR-AVEESDLDKLPFLRCVYK |
| Wheat_W5AZI1 | LFGGPETVGSMTEWAMAENMRSPDLRRLQRELANYVGLHR-TVDETDLDKLPFLRCVYK |
| Banana_XP_009411495.1 | MFGGTETVASAIEWALADLLTSPDLRRVQQELLAMVVGLDR-KVHESHLDKLSFLKCAIK |
| Banana_XP_009384541.1 | MFSGTETVASAIEWANAELMKSFEDMRRVQQELLAMVVGLDR-KVHESDLDKLSFLKCVTK |
| Rice_Os10g0512400 | MFGGTETVASAIEWAMAELMKSFEDMRRVQEELASVVGLHR-KVRESDLDKIPHKCAVK |
| Maize_A0A0B4J2K1 | MFGGTETVASAIEWAMAEMMHSFDLRRLQQELADVVGLGR-DVAESDLDKLPFLRCVIK |
| Maize_B4FWF9 | MFGGTETVASAIEWAMAEMMHSFDLRRVQQELADVVGLDR-NVNESDLDKLPFLRCVIK |
| Wheat_W5AC21 | MFGGTETVASAIEWAMAEMMHSPDLRRVQQELADVVGLDR-NVSESDLDRLPFLRCVIH |
| Wheat_W5B6W3 | MFGGTETVASGIEWAMTENMMHSFNDLLQLQQRELADTVGIDR-NVDSPDLNKLSFLKCVIH |
| Wheat_A0A077RQ37 | MFGGTETVASAIEWAMSRMMHCPDLRRLQQELADTVGLDQ-NVDESDLDKLPFLRCVIK |
| | :*:  *:. **:.::::::  *  *::::::: **:  :  *:.  :*:. :*: |

```
Pear_XP_009338655.1        ETIRLRPPIPLILHETSEDAVVAGYRIPKKSRVMINAWAIGRKDSW--EDRESFKPSRFL
Banana_XP_009403617.1      EMIRLRPELPLLQHQATQDCELAGYIPVGTRVFVNAWGTGRDRDAW--KSFNAFPSRPA
Rice_Os03g0112900          ETIRLRPPIPLILHEAAADCVVGGYSVPRGARVVVNVWSVGRDAGAWKGDAGAFRRARPM
Onion_AC.SP3B.Locus_5396.1.10  ETIRLRPPIPLILHETAEDCEIQGYSIPKKSRVMINVWAIGRDKSAW--KDADQFKPSRFV
Wheat_A0A077RP65           EALRMHPPIPVLLHEAAKDCVVGGYSIPRGSRVLVIAWAINRDCGAW--KDGDTFRPARFI
Wheat_W5AZI1               ETLRLRPFPIPLLLHQTADHCEVAGYSIFARSPVMINVWAIWRDPGAW--KDGDTFRPSRFM
Banana_XP_009411495.1      ETIRLRPPIPLLLHETAEDCEVAGTTVFARSRVMINVWAIGRDESAW--KDADAYFPSRFA
Banana_XP_009384541.1      ETIRLRPPIPLLLHETAERCQLTGYAVPARSRIMTNVWAIGRDKSAW--EDADAFRPSRFT
Rice_Os10g0512400          ETLRLHPPIPILHETAADCLVAGYSVPRGSRVWNVWAIARDRAAWGPDADAFRPSKFA
Maize_A0A084J2X1           ETLRLRPPIPLILHETAGDCVVGGYSVPRGSRVMVNVWAIGRHRASW--KDADAFRPSRFT
Maize_B4FW79               ETIRLRPPIPLILHRENARDCVLGGYSVPQGSSVRINVEAMGRDTKVW--KDADTFRPSRFM
Wheat_W5AC21               ETIRLRPPIPIPLLLHHENAEDCVVGGYSVPRGSSVMINVFAIGRDAKVW--KDADTKFSRFM
Wheat_W5B6W3               ETIRLRPPIPLINRENAEDCVVGGYSVPRGSRVMINVFAIGRDASTW--KDADAFRPSRFM
Wheat_A0A077RQ37           
                           : ::*: **::.:   :         :   :  * :  :           ::*:**
```

FIG. 4 continued

| Name | Sequence |
|---|---|
| Celery_RZ_draft_99.605_EVM36363 | DVGAP----DYRNRFEFIPGGNRASCPGMQLGLHAPEMGLAHLLACFNWELPDGMKFS |
| Brassica_XP_013607401.1 | DPGAP----DLKGNSFEFIPFGSGRRSCPGMQLGMYAFELAVAHLLACFTWRLPDGVXFG |
| Radish_rs_Aokubi_v1_EVM13601 | DPGAP----DLKGNSFEFIPFGSGRRSCPGMQLGLYAFELAVAHLLACFTWKLPNGVKFG |
| Brassica_Bo7g119430 | DSKAP----DFKGSDFEELPFGSRRSCPGMQLGLYAMELAVARMLRSFDWELPEGGSSD |
| Radish_GSRAST00042054001 | BDKAP----DFKGSDFEELPFGSGRRSCPGMQLGLYAMELAVARMLRSFDWKLPEGVSSG |
| Peach_XP_007199246.1 | EDGSP----DFKGSNFEFIPGSGRRSCPGMALGLYGLEMAVAHLLCFAWELPGGMKPS |
| Apple_XP_008391587.1 | EDSSP----DFKGSNFEFIPGSGRRSCPGMALGLYGLEMAVAHLLCFAWELPGGMKPS |
| Pear_XP_009378429.1 | DDGSP----DFKGSNFEFIPGSGRRSCPGMALGLYGLEMAVAHLLCFAWELPGGMKPS |
| Eggplant_sm_67_3_v1_EVM112823.1 | KEGVA----DFKGGDFEFLPFGSGRRSCPGMQMGLYAFEMTLAHLLHCFWELPNGMKPS |
| Celery_RZ_draft_99.605_EVM348724 | KQGMP----DFKGSNFEFIPFGSGRRSCPGMQLGLYAFEMAVARHLLHSPNWELPDGMKPS |
| Celery_c17480_g1_i1|m.26831 | QBGMP----DFKGSNFEFIPFGSGRRSCPGMQLGLYALELAVARLLLHSPNWELPDGMKPS |
| Artichoke_KVI02697.1 | BNGAP----DFKGSNYEFLPFGSGRRSCPGMQLGLYAMEMAVAHLLHSFTWQLPDGMKPS |
| Lettuce_lsFSH_2_1 | QDGAP----DFKGSNYEFLPNSGGRASCPGMQLGLYAMEMAVAHLLHSFTWQLPDGMKFS |
| Endive_ce_kethel_v0.1_EVM71979 | QDGAP----DFKGSNYEFLPSSGRRSCPGMQLGLYAMEMAVAHLLHSFTWQLPDGMKPS |
| Chicory_ci_vitessa_fr_v1_EVM1585 | QDGAP----DFKGSNYEFLPFGSGRRSCPGMQLGLYAMEMAVAHLLHSFTWQLPDGMKPS |
| Artichoke_KVH97322.1 | QNGAP----DFRGSNYEFLPFGSGRRSCPGMQLGLYAMEMAVVHLLHCFNWELPDGMKFS |
| Lettuce_lsFSH_1_1 | QNGAP----DFRGSNYEFL.PFGSGRRSCPGMQLGLYAMEMAVAHLLCFTWKLPDGMKPS |
| Endive_ce_gene1 | ONGAP----DFKGSNYEFLPFGSGRRSCPGMQLGLYAMEMAVAHLLCFTWDLPDGMKPS |
| Chicory_ci_vitessa_fr_v1_EVM1707 | ONGAP----DFKGSNYEFLPFGSGRRSCPGMQLGLYAMEMAVAHLLCFTWKLPDGMKPS |
| Endive_ce_gene2 | ONGAP----DFRGSNYEFLPFGSGRRSCPGMQLGLYAMEMAVAHLLCFTWKLPDGMKPS |
| Chicory_ci_vitessa_fr_v1_EVM1707 | ONGAP----DFRGSNYEFLPFGSGRRSCPGMQLGLYAMEMAVAHLLCCFTWELPDGMKPS |
| Brassica_Bo9g093960 | EPGMP----DFMGTNFEFIPFGAGRRSCPGMQLGLYAMEMAVAVANIIHCFTWKLPDGMKPS |
| Radish_GSRAST00001008001 | EPGMP----DFMGTNFEFIPFGAGRRSCPGMQLGLYAMEMAVAVANIIHCFTWKLPDGMKPS |
| Brassica_Bo7g117840 | EPGVA----DFKGSNFEFIPFGSGRRSCPGMQLGLYRLELAVARHLLHCFTWKLPDGMKPS |
| Radish_GSRAST00007419001 | EPGVA----DFKGSNFEFIPFGSGRRSCPGMQLGLYALELAVAHLLHCFTWKLPDGMKPS |
| Brassica_Bo1g005770 | EPGVP----DFKGSNFEFIPFGSGRRSCPGMQLGLYALELAVAHLLHCFTWKLPDGMKPS |
| Radish_GSRAST00026395001 | EPGVP----DFKGSNFEFIPFGSGRRSCPGMCLGLYALELAVAHLLHCFTWKLPDGMKPS |
| Eggplant_c18725_g1_i1|m.19489 | KQGVP----DFKGGNFEFLPFGSGRRSCPGMQLGLYALELAMAHLLHCFTWELPDGMKPS |
| Potato_XP_006340697.1 | KPGVP----DFKGGNFEFLPFGSGRRSCPGMQLGLYALELAMAHLLHCFTWELPDGMKPS |
| Soybean_K7MH28 | RPNVP----DFKGSNFEFIPFGSGRRSCPGMQLGLYTIELAMAHLLHCFTWELPDGMKPS |
| Soybean_G3E7M3 | KPGVP----DFKGSNFEFIPFGSGRRSCPGMVLGLYALELAVARLLACFTWELPDGMKPS |
| Soybean_I1J8P0 | KPGVP----DFKGSNFEFIPFGSGRRSCPGMVLGLYALELAVARLLACFTWELPDGMKPS |
| Soybean_I1L8Y5 | KPGVP----DFKGSNFEFIPFGSGRRSCPGMVLGLYALELAVARLLACFTWELPDGMKPS |
| Soybean_Q2LAL3 | KPGVP----DFKGSNFEFIPFGSGRRSCPGMVLGLYALELAVARLLACFTWELPDGMKPS |
| Peach_XP_007203643.1 | KEGVP----DFKGSNFEFIPFGSGRRSCPGMVLGLYALELAVGHLLACFTWELPDGMKPS |
| Apple_XP_008337913.1 | REGVP----DFKGSNFEFIPFGSGRRSCPGMVLGLYALELAVARMLHCFTWELPDGMKPS |
| Pear_XP_009346304.1 | KEGVP----DFKGSNFEFIPFGSGRRSCPGMQLGLYALEMAVARMLHCFTWELPDGMKPS |
| Pear_AGR44939.1 | KDGVP----DFKGSNFEFIPFGSGRRSCPGMQLGLYALEMAVARMLHCFTWELPDGMKPS |
| Apple_XP_008372753.1 | KEGVP----DFKGSNFEFIPFGSGRRSCPGMQLGLYALEMAVAHLLACFTWELPDGMKPS |
| Pear_XP_009378215.1 | KEGVP----DFKGSNFEFIPFGSGRRSCPGMQLGLYALEMAVAHLLACFTWELPDGMKPS |

FIG. 4 continued

```
Pear_XP_009338655.1         KEGVP------DFKGSNFEYTPFGSGRRSCPGMQLGLYALEMAVAHLLHCFTWELPDGMKPS
Banana_XP_009403617.1       LGGDA--AAFDFRGSCFELLPFGSGRRSCPGMQLGLYVLELAVAQLLHCFDWSLPAGTKPG
Rice_Os03g0112900           AGGEA--AGMDLRGGCFELLPFGSGRRACPAIVLGMYELELIVVARLVHAFGWAPFGGVAPE
Onion_AC.SP3B.Locus_5396.1.10 KGGEY-EQVDFKGNFFELLPFGAGRRSCPGMQLGLYALDITVARMARCFDWELPDGMKFG
Wheat_A0A077RP55            PGEGEAAGLDLKGSCYEFLPFGSGRRSCPAQGLGQHAVEFAVAQLAHGFNWKLPDGMKPA
Wheat_W5A2I1                PGGDA--AALDLNGGCYEFLPFGSGRRSCPAQGLGQHAVEFAVAQLAHGFNWELPDGMKFA
Banana_XP_009411495.1       PGGDA--AALDFKGNCFEFLPFGSGRRSCPGMQLGMHELELAVAQLHCFTWALPDGMKFT
Banana_XP_009384541.1       PGGCA--ASLDFKGNYFEFLPFGSGRRSCPGMQLGLRALLELAVAQLIHCFTWTLPDGMKPS
Banana_XP_009384087.1       PGGHA--AALDFKGGCFEFLPFGSGRRSCPGMQLGLRALELAVAQLIHCFSWELPDGMKPG
Rice_Os10g0512400           AGAAA--EGLDFRGGCFEFLPFGSGRRSCPGTALGLYALELAVARLAHGFNWSLPDGMKPS
Maize_A0A0B4J2X1            PEGEA--AGLDFKGGCFEFLPFGSGRRSCPGTALGLYALELAVAQLAHGFNWSLPDGMKPS
Maize_B4FWF9                APEGEAAGLDFKGGCFEFLFGSGRRSCPGMALGLYALELAVAQLAHAFNWSLPDGMKPS
Wheat_W5AC21                EGEGEAAGVDFKGGCFQFLPFGSGRRSCPGMALGLYSLELVIAQLAHGFNWALPNGEXPS
Wheat_W5R6W3                TGEGEAARVDFKGSCFEFLPFGSRRRSCPGMAIGIYSLEFAVAQLAHGFSWALPDGMKPS
Wheat_A0A077RQ37            EGEGEAAGYDFKGGCFEFLPFGSGRRSCPGMALGLYSIELIVAQLAHGPNLALPDGMAPS
                                         *  :;;:*******;**  ;*  :  ;;  :: ;; *  * *
```

FIG. 4 continued

```
Celery_Rz_draft_99.605_EVM36363        QVDMSDMYGLSAPKATRLIAVPTPRLLCPIC-------
Brassica_XP_013607401.1                DVDTIBGPGLTVAKAMSLVAVPIKRLLCPWVLESNRV--
Radish_rs_Aokubi_v1_EVM13601           DVDTIBGPGLTVPKAMSLVAVPTRLLSPIVLESNRV---
Brassica_Bc7g119430                    DLDMTDMFGLTAPKATRLIAVPSTRLKCPWVI-------
Radish_GSBRAST00042054001              DLDMTDMFGLTAPKATRLIAVPSTRLKCPWVI-------
Peach_XP_007199246.1                   ELDMKDVFGLTAPKAAQLAAVPSRLMCPL----------
Apple_XP_008591587.1                   ELDMKDVFGLTAPKAVQLVAVPTRLMCPL----------
Pear_XP_009378429.1                    ELDMKDVFGLTAPKAVQLVAVPTYRLMCPL---------
Eggplant_sm_67_3_v1_EVM112823.1        DLDMNDVFGLTVPKATRLVAVPTPRLLCQLY--------
Celery_Rz_draft_99.605_EVM348724       ELDTNDVFGLTAPRATRLVAVPTRLLCSIC---------
Celery_ci7480_gl_i1m.26831             ELDTDVFGLTAPKATRLVAVPTRLLCPIS----------
Artichoke_KVI02897.1                   EVDTDVFGLTAPKAIRLVAVPTRLLCPLY----------
Lettuce_LsFSR_2_1                      EIDMTDVFGLTAPKATRLVAVPTRLLCPLY---------
Endive_ce_kethel_v0.1_EVM71979         EIDMKDVFGLTAPKAIRLVAVPTPRLLCPLY--------
Chicory_ci_vitessa_fr_v1_BVM1585       EIDMSDVFGLTAPKAIRLVAVPTRLLCPLY---------
Artichoke_KVH92322.1                   EIDMGDVFGLTAPKAIRLVAVPTRLLCPLY---------
Lettuce_LsFSR_1_1                      EIDMSDVFGLTAPKAIRLVAVPTRLLCPLY---------
Endive_ce_gene1                        EIDMSDVFGLTAPKAIRLVAVPTRLLCPLY---------
Chicory_ci_vitessa_fr_v1_BVM1707       EIDMSDVFGLTAPKAIRLVAVPTRLLCPLY---------
Endive_Ce_gene2                        EIDMSDVFGLTAPKAIRLVAVPTRLLCPLY---------
Chicory_ci_vitessa_fr_v1_EVM1707       EIDMGDVFGLTAPKATRLIAVPTRLLCPLY---------
Brassica_Bc3g093960                    ELDMSDVMGLTAPKATRLIAVPDTRLLCHYP--------
Radish_GSBRAST00001086001              ELDMGDVMGLTAPKATRLIAVPDTRLLCSVMP-------
Brassica_Bo7g117840                    ELDMKDVFGLTAPKATRLFAVPSTRLICAV---------
Radish_GSBRAST00007419001              ELDMKDVFGLTAPKATRLFAVPSTRLICAV---------
Brassica_Bo1g005770                    ELDMSDVFGLTAPKATRLYAVPSTRLICSV---------
Radish_GSBRAST00026355001              ELDMSDVFGLTAPKATRLYAVPSTRLICAV---------
Eggplant_c18725_g1_i1/m.19489          ELKMDDTFGLTAPLANRLVVVSERLLCTLV---------
Potato_XP_006340697.1                  ELKMDDIFGLSAPLAMRLVAVPTRLLAN-1---------
Soybean_K7MH28                         ELDTSDVFGLSAPRASRLVAVPTKRVCPL----------
Soybean_G3E7M3                         EMDMGDVFGLTAPRSTRLIAVPTKRVVCPLF--------
Soybean_I1J8P0                         EMDMGDVFGLTAPRSTRLIAVPTKRVVCPLF--------
Soybean_I1LHY5                         ENDMGDVFGLTAPRSTRLIAVPTKRVVCPLF--------
Soybean_Q2IAL3                         EMDMGDVFGLTAPRSTRLIAVPSKRVVCPLF--------
Peach_XP_007203643.1                   ELDMNDVFGLTAPRASRLIAVPSKRVVCPL---------
Apple_XP_008337913.1                   ELDMNDVFGLTAPRASRLIAVPSKRVVCPL---------
Pear_XP_009346304.1                    ELDMNDVFGLTAPRASRLIAVPSKRVVCPLF--------
Pear_AGR44939.1                        ELDMNDVFGLTAPRASRLIAVPSKRVVCPL---------
Apple_XP_008372753.1                   ELDMNDVFGLTAPKASRLIAVPSKRVVCPL---------
Pear_XP_009376215.1                    ELDMNDVFGLTAPKASRLIAVPSKRVVCPL---------
```

FIG. 4 continued

```
Pear_XP_009338655.1              ELDMNDVFGLTAPRASKLIAVFSKRVVCPL----------
Banana_XP_009403617.1            DLDMGDVFGLTAPKAVKLMAVPTPRLICPLL---------
Rice_Os03g0112900                ELDMADSFGLTAPRAARLRAVPTPRLRCPM----------
Onion_AC.SP3B.Locus_5396.1.1.10  BMRMSDVFGLTAPKAVRLAAVPSPRLTCRI----------
Wheat_A0A077RPS5                 ELDMGDIFGLTASRSTKLIAVPTPRLTCPV----------
Wheat_W5A2T1                     ELDMGDIFGLTALKATKLIAVPTPRLTCPM----------
Banana_XP_009411495.1            ELDMGDVFGLSAPKAVPLVAVPTPRLSCPIM---------
Banana_XP_009384541.1            ELDMGDVFGLTAPKAVRLAAVPAPRLSCPLY---------
Banana_XP_009384087.1            ELDMGDMFGLTAPRAVRLVAVPTPRLICPLL---------
Rice_Os10g0512400                ELDMSDIFGLTAPRATRLSAVATPRLTCPLY---------
Maize_A0A0B4J2X1                 ELDMGDVFGLTAPRATRLYAVPTPRLNCPLY---------
Maize_B4FWF9                     BMDMGDIFGLTAPRATRLYAVPTPRLNCPLY---------
Wheat_B4FWF9                     VLDMSDIFGLTAPRATRLWVFPTPRLTCPLVVDV------
Wheat_W5AC21                     ELDMTDIFGLTAFRATRLCAVFFRRLTVPLISSVDATHKGWT
Wheat_A0A077RQ37                 ELDMRDVFGLTVPRATRLCVFFPRLPCSLVADDDAARQA--
                                 :  :  :  ****::  :    **:: **.   *:
```

| Score | Description | Picture |
|---|---|---|
| 9 | No discoloration around the edges | |
| 8 | Very slight pink discoloration around the edges | |
| 5 | Thin ring of red/pink discoloration around the edges | |
| 2 | Darker and thicker ring of red/pink discoloration around the edges | |
| 0 | Very dark red and thick ring of discoloration around the edges | | pink

FIG. 5

1 Day

2 Days

3 Days pink

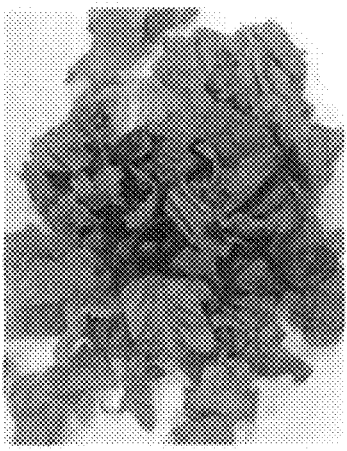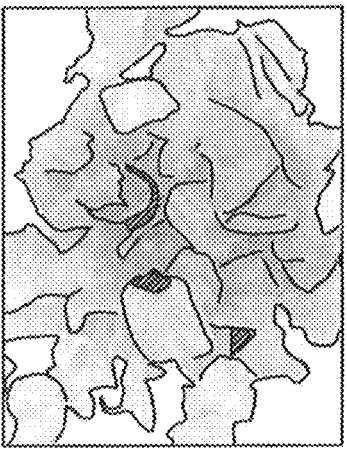
FIG. 7-2

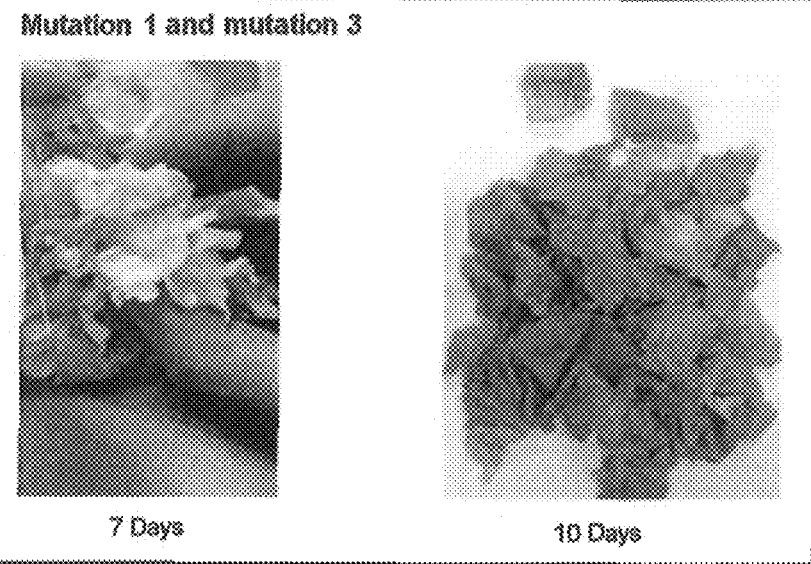
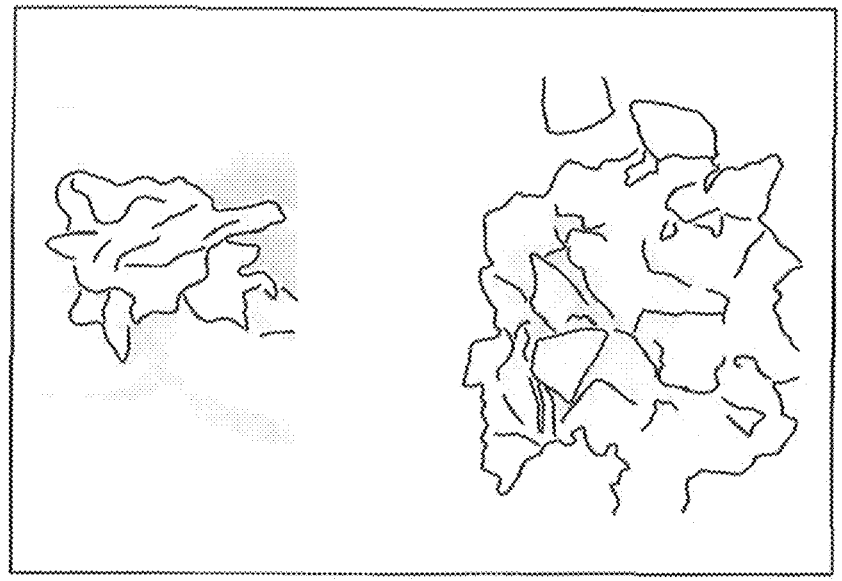
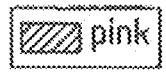
FIG. 7-3

PLANTS SHOWING A REDUCED WOUND-INDUCED SURFACE DISCOLORATION

RELATED APPLICATIONS AND INCORPORATION BY REFERENCE

This application is a continuation-in-part application of international patent application Serial No. PCT/EP2017/054343 filed 24 Feb. 2017, which published as PCT Publication No. WO 2017/144669 on 31 Aug. 2017, which claims benefit of European patent application Serial No. PCT/EP2016/053895 filed 24 Feb. 2016 and European patent application Serial No. PCT/EP2016/053999 filed 25 Feb. 2016.

The foregoing applications, and all documents cited therein or during their prosecution ("appln cited documents") and all documents cited or referenced in the appln cited documents, and all documents cited or referenced herein ("herein cited documents"), and all documents cited or referenced in herein cited documents, together with any manufacturer's instructions, descriptions, product specifications, and product sheets for any products mentioned herein or in any document incorporated by reference herein, are hereby incorporated herein by reference, and may be employed in the practice of the invention. More specifically, all referenced documents are incorporated by reference to the same extent as if each individual document was specifically and individually indicated to be incorporated by reference.

FIELD OF THE INVENTION

The present invention relates to a plant that shows reduced wound-induced surface discoloration. The invention further relates to a modified gene homolog that leads to the reduced wound-induced surface discoloration in a plant, to its sequences and the use of these sequences for identifying the presence of the modified gene homolog. The invention also relates to the seeds and progeny of such plants and to propagation material for obtaining such plants.

BACKGROUND OF THE INVENTION

In recent years, consumer convenience as well as the development of new products has contributed to the increasing choice of processed vegetables and fruits available on the market. Ready-to-eat products, i.e. in a cut, washed and packaged form, may include lettuce (*Lactuca sativa*) and other leafy vegetables such as chicory (*Cichorium intybus*) and endive (*Cichorium endivia*), either individually processed or in mixed compositions. One of the most important and frequently encountered problems during harvesting, processing and storage of vegetables is the development of wound-induced surface discoloration visible by a pink discoloration at the wound surface of the plants or parts thereof which gradually turns brown after prolonged storage. Other crop plants such as potato (*Solanum tuberosum*), onion (*Allium cepa*), artichocke (*Cynara cardunculus* var. *Scolymus*), rice (*Oryza sativa*), corn (*Zea mays*), peach (*Prunus persica*), eggplant (*Solanum melongen*), celery and celeriac (*Apium graveolens*), apple (*Malus domestica*), banana (*Musa acuminate*), soy (*Glycine max*), pear (*Pyrus× bretschneideri*), wheat (*Triticum aestivum*), radish (*Raphanus sativus*), cabbage and cauliflower (*Brassica oleracea*) etc. may also be subject to the wound-induced surface discoloration visible on the plant or parts thereof, such as leaves, whole plant heads, fruits, inflorescences, seeds, curds, stems, tubers, bulbs and roots etc.

Wound-induced surface discoloration or wound-induced discoloration is caused by a strong wound response at and around the wound and leads to a rapid deterioration of the harvested and optionally processed product. Consumers consider discoloration of vegetables and fruits to be unattractive and to compromise the product quality, thus reducing the product's marketability and/or leading to a waste of harvested and optionally processed products.

The wound response is a means of a plant or part thereof to heal the wound and defend itself against pathogens by creating a new insulation barrier. The response is a complex biological response of a plant to physical injury such as cutting or bruising, and implies the activity of numerous proteins. The local response is mainly aimed at closing the wound surface which is effectuated by the local death of cells at or just behind the wound surface. In addition to these visible effects, other responses like increased respiration or ethylene production are known to be induced.

At the biochemical level, studies have shown that wounding can lead to the induction of the phenylpropanoid pathway (PP pathway) which is required for inter alia the production of polyphenols and other compounds important for the plant.

The first step of the PP pathway is the conversion of the amino acid phenylalanine into cinnamic acid by the phenylalanine ammonia-lyase (PAL). PAL is enhanced upon wounding by the induction of gene expression of at least one of its isoforms. This response leads to the formation of polyphenols which are oxidized by the polyphenol oxidase (PPO). PPO is residing in plastids and is released and activated upon wounding. Oxidation of polyphenols lead to the formation of highly reactive quinones, that can react with amino acids or proteins which leads to pink, brown or black discoloration.

In order to reduce the wound-induced surface discoloration in vegetables such as lettuce, many post-harvest and post-processing treatments have been developed and applied. Examples of chemical or physical treatments are the packaging of fresh cut leafy vegetables under a modified atmosphere, the application of edible coatings, heat-shock treatment and the addition of chemicals.

Although these treatments prevent the appearance of the wound-induced discoloration, the harvested and eventually processed product is still susceptible to discoloration if the package is damaged or shortly after opening the package. In addition, the use of chemicals and the need for specialized equipment for such treatments significantly increases costs. For these reasons, a more viable genetically-based solution which works to reduce wound-induced surface discoloration in plants is preferred.

Citation or identification of any document in this application is not an admission that such document is available as prior art to the present invention.

SUMMARY OF THE INVENTION

In the research leading to the present invention, it was surprisingly found that modifications to a F5H gene homolog in plants lead to a reduction of wound-induced surface discoloration, as compared to plants or parts thereof not which may comprise such modifications in their corresponding wild type F5H gene homologs. The F5H gene homologs code for Ferulate 5-hydroxylase (F5H) protein homologs. In *Arabidopsis thaliana* two F5H gene homologs are described and called F5H1 and F5H2. The F5H enzyme is part of a PP pathway where it is responsible for the hydroxylation of coniferaldehyde and coniferyl alcohol. The F5H protein belongs to a new family of plant cytochrome P450-dependent mono-oxygenase called CYP84. However, the implication of F5H in the wound-induced surface discoloration has not yet been described.

It is an object of the present invention to provide a plant that shows reduced wound-induced surface discoloration.

The present invention thus provides a plant which may comprise a modified F5H gene homolog, wherein said gene homolog may comprise a modification as compared to its corresponding wild type F5H gene homolog, wherein the presence of the modified F5H gene homolog in the plant leads to a reduction of wound-induced surface discoloration in comparison to a plant not which may comprise the modified F5H gene homolog.

Accordingly, it is an object of the invention not to encompass within the invention any previously known product, process of making the product, or method of using the product such that Applicants reserve the right and hereby disclose a disclaimer of any previously known product, process, or method. It is further noted that the invention does not intend to encompass within the scope of the invention any product, process, or making of the product or method of using the product, which does not meet the written description and enablement requirements of the USPTO (35 U.S.C. § 112, first paragraph) or the EPO (Article 83 of the EPC), such that Applicants reserve the right and hereby disclose a disclaimer of any previously described product, process of making the product, or method of using the product. It may be advantageous in the practice of the invention to be in compliance with Art. 53(c) EPC and Rule 28(b) and (c) EPC. All rights to explicitly disclaim any embodiments that are the subject of any granted patent(s) of applicant in the lineage of this application or in any other lineage or in any prior filed application of any third party is explicitly reserved. Nothing herein is to be construed as a promise.

It is noted that in this disclosure and particularly in the claims and/or paragraphs, terms such as "comprises", "comprised", "comprising" and the like can have the meaning attributed to it in U.S. Patent law; e.g., they can mean "includes", "included", "including", and the like; and that terms such as "consisting essentially of" and "consists essentially of" have the meaning ascribed to them in U.S. Patent law, e.g., they allow for elements not explicitly recited, but exclude elements that are found in the prior art or that affect a basic or novel characteristic of the invention.

These and other embodiments are disclosed or are obvious from and encompassed by, the following Detailed Description.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

The following detailed description, given by way of example, but not intended to limit the invention solely to the specific embodiments described, may best be understood in conjunction with the accompanying drawings.

Figure 1:
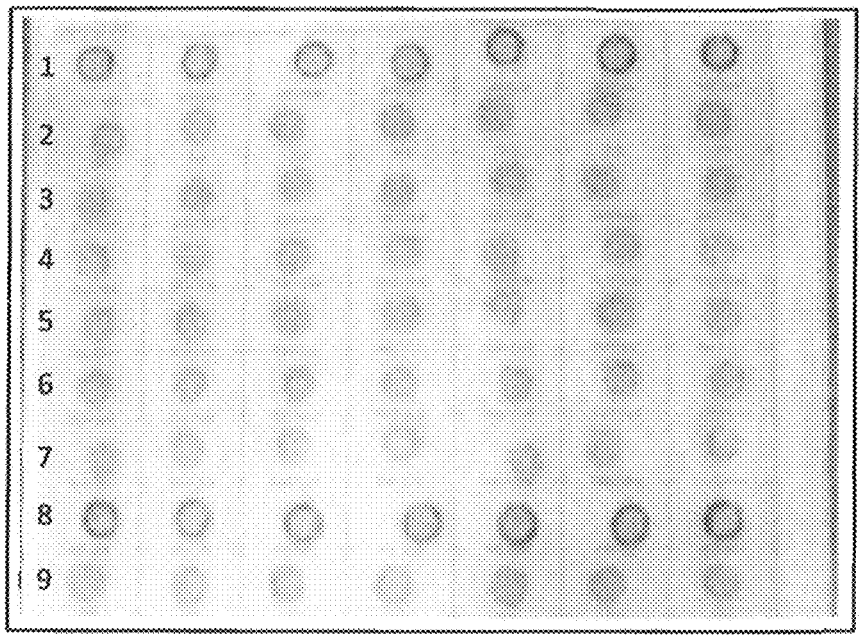
Figure 1:
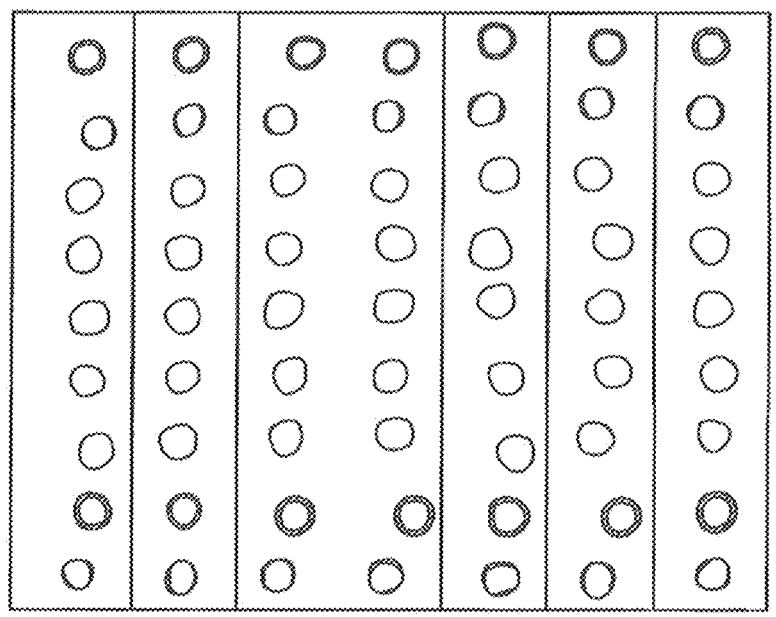
Figure 1:

In the examples reference is made to the following figures:

FIG. 1: Leaf discs of the phenotypic test described in Example 2 at 3 days of incubation of *Lactuca sativa* samples of the WT and different mutants. Line 1 and line 8 are leaf disc samples taken from wild type lettuce plants, line 2 and line 9 are leaf disc samples taken from lettuce plants which may comprise mutation 1, line 3 are leaf disc samples taken from lettuce plants which may comprise mutation 1 and mutation 2, line 4 are leaf disc samples taken from lettuce plants which may comprise mutation 1 and mutation 3, line 5 are leaf disc samples taken from lettuce plants which may comprise mutation and mutation 4, line 6 are leaf disc samples taken from lettuce plants which may comprise mutation and mutation 5 and line 7 are leaf disc samples taken from lettuce plants which may comprise mutation and mutation 6. The mutations are represented in Table 3.

Figure 2:
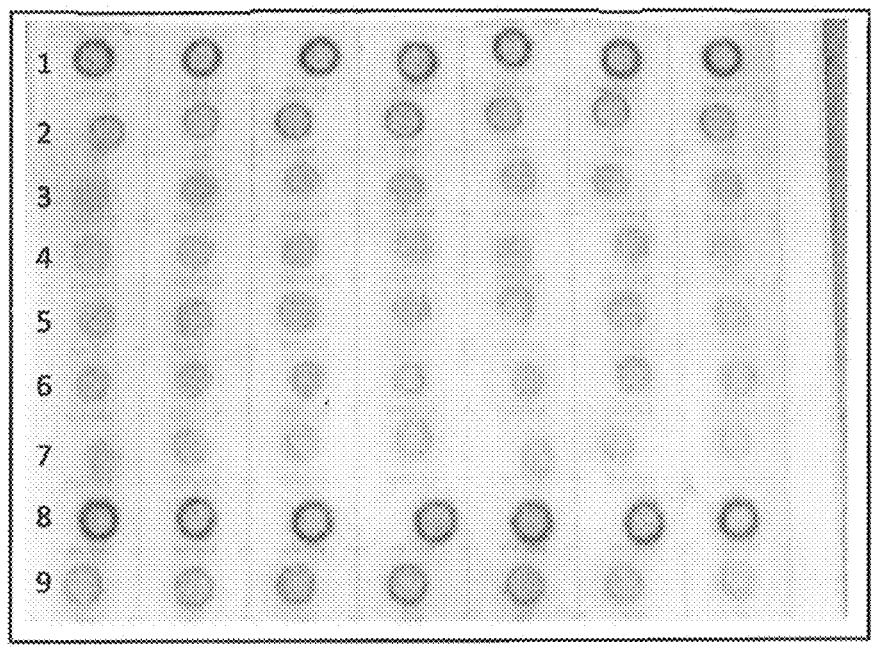
Figure 2:
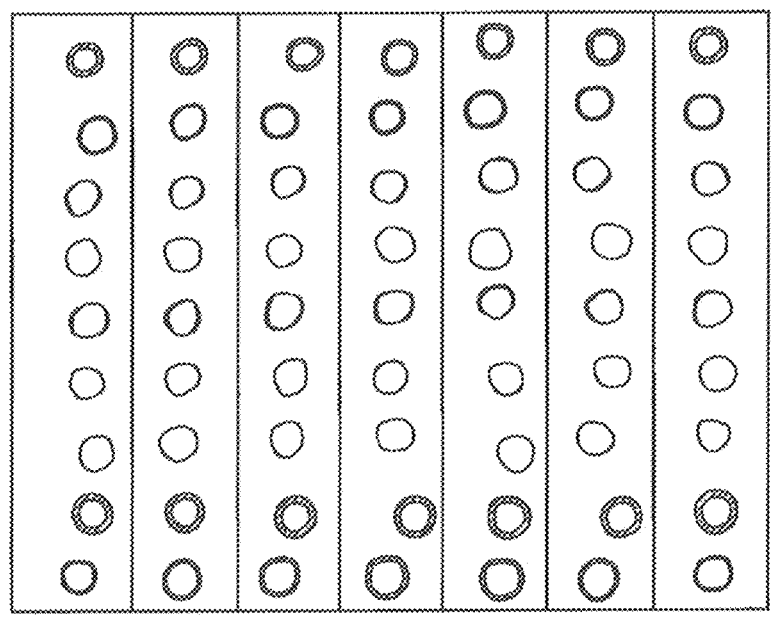
Figure 2:

FIG. 2: Leaf discs of the phenotypic test described in Example 2 at 5 days of incubation of *Lactuca sativa* samples of the WT and different mutants. Line 1 and line 8 are leaf disc samples taken from wild type lettuce plants, line 2 and line 9 are leaf disc samples taken from lettuce plants which may comprise mutation 1, line 3 are leaf disc samples taken from lettuce plants which may comprise mutation 1 and mutation 2, line 4 are leaf disc samples taken from lettuce plants which may comprise mutation 1 and mutation 3, line 5 are leaf disc samples taken from lettuce plants which may comprise mutation and mutation 4, line 6 are leaf disc samples taken from lettuce plants which may comprise mutation and mutation 5 and line 7 are leaf disc samples taken from lettuce plants which may comprise mutation and mutation 6. The mutations are represented in Table 3.

Figure 3:
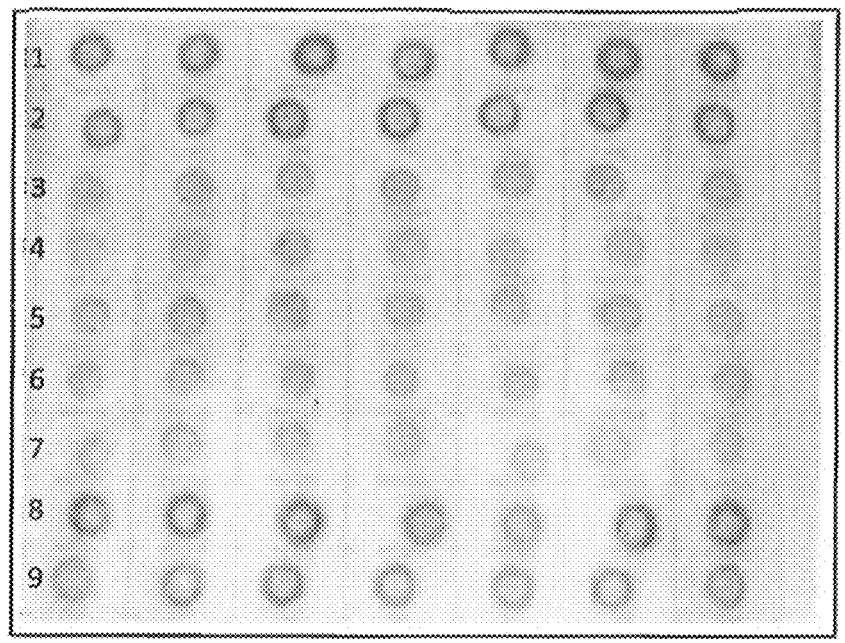
Figure 3:
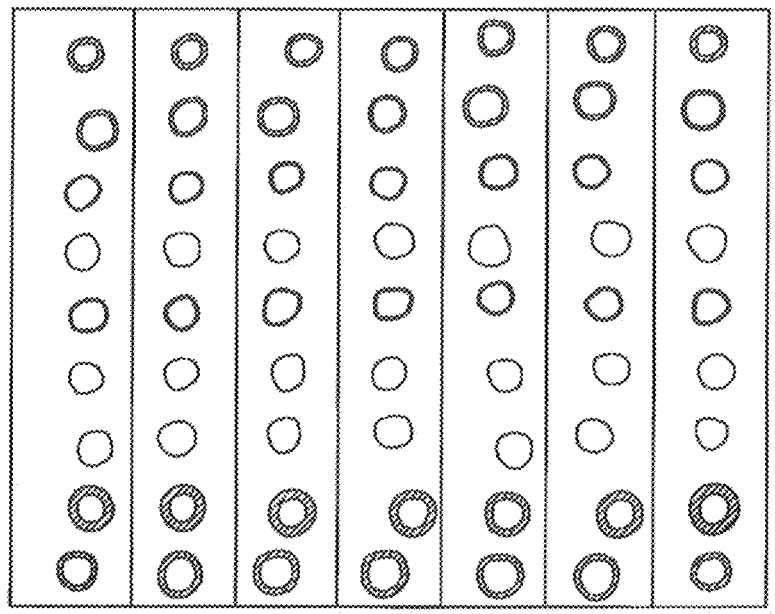
Figure 3:
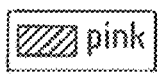

FIG. 3: Leaf discs of the phenotypic test described in Example 2 at 10 days of incubation of *Lactuca sativa* samples of the WT and different mutants. Line 1 and line 8 are leaf disc samples taken from wild type lettuce plants, line 2 and line 9 are leaf disc samples taken from lettuce plants which may comprise mutation 1, line 3 are leaf disc samples taken from lettuce plants which may comprise mutation 1 and mutation 2, line 4 are leaf disc samples taken from lettuce plants which may comprise mutation 1 and mutation 3, line 5 are leaf disc samples taken from lettuce plants which may comprise mutation and mutation 4, line 6 are leaf disc samples taken from lettuce plants which may comprise mutation and mutation 5 and line 7 are leaf disc samples taken from lettuce plants which may comprise mutation and mutation 6. The mutations are represented in Table 3.

Figure 4:
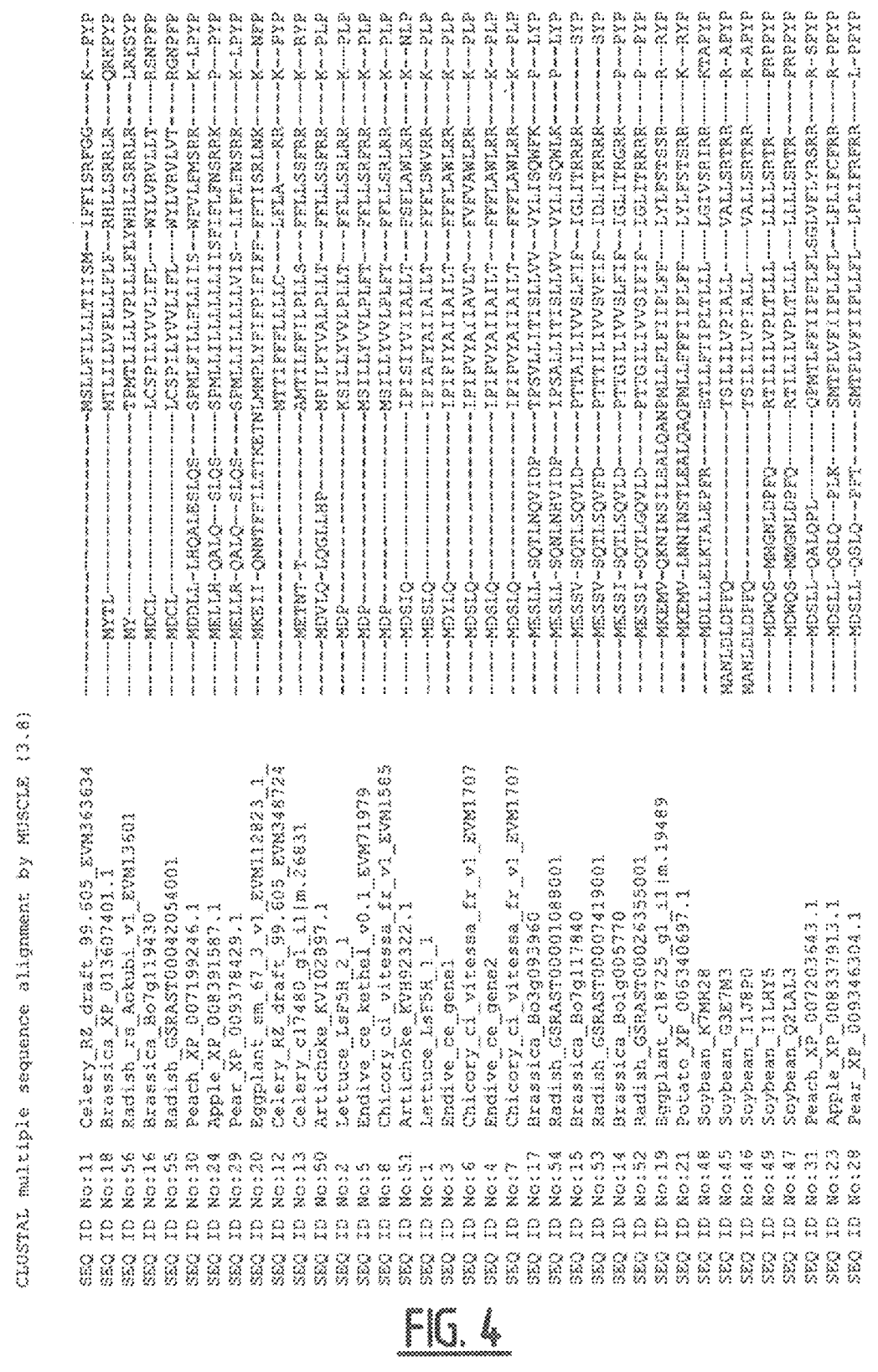
Figure 4:
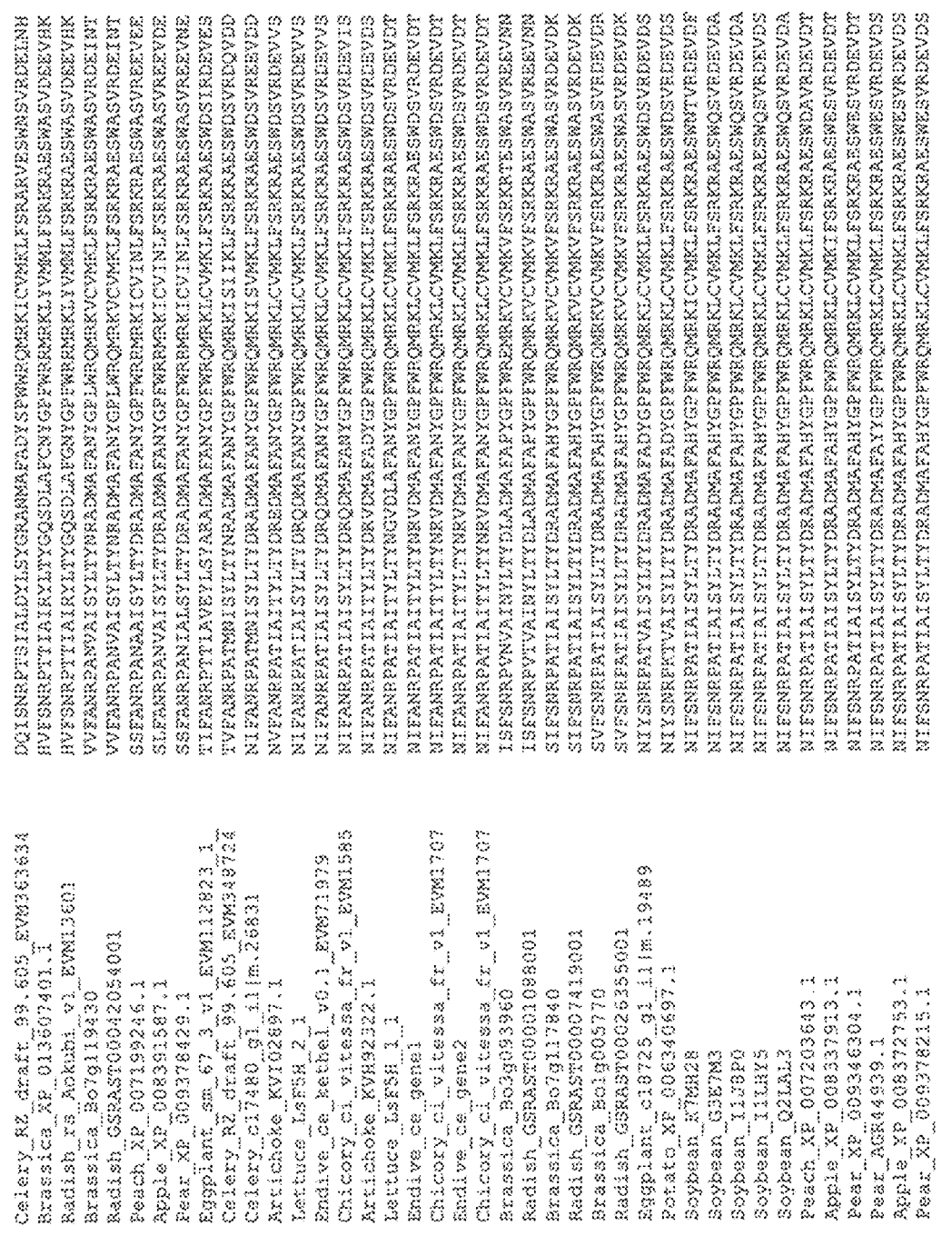
Figure 4:
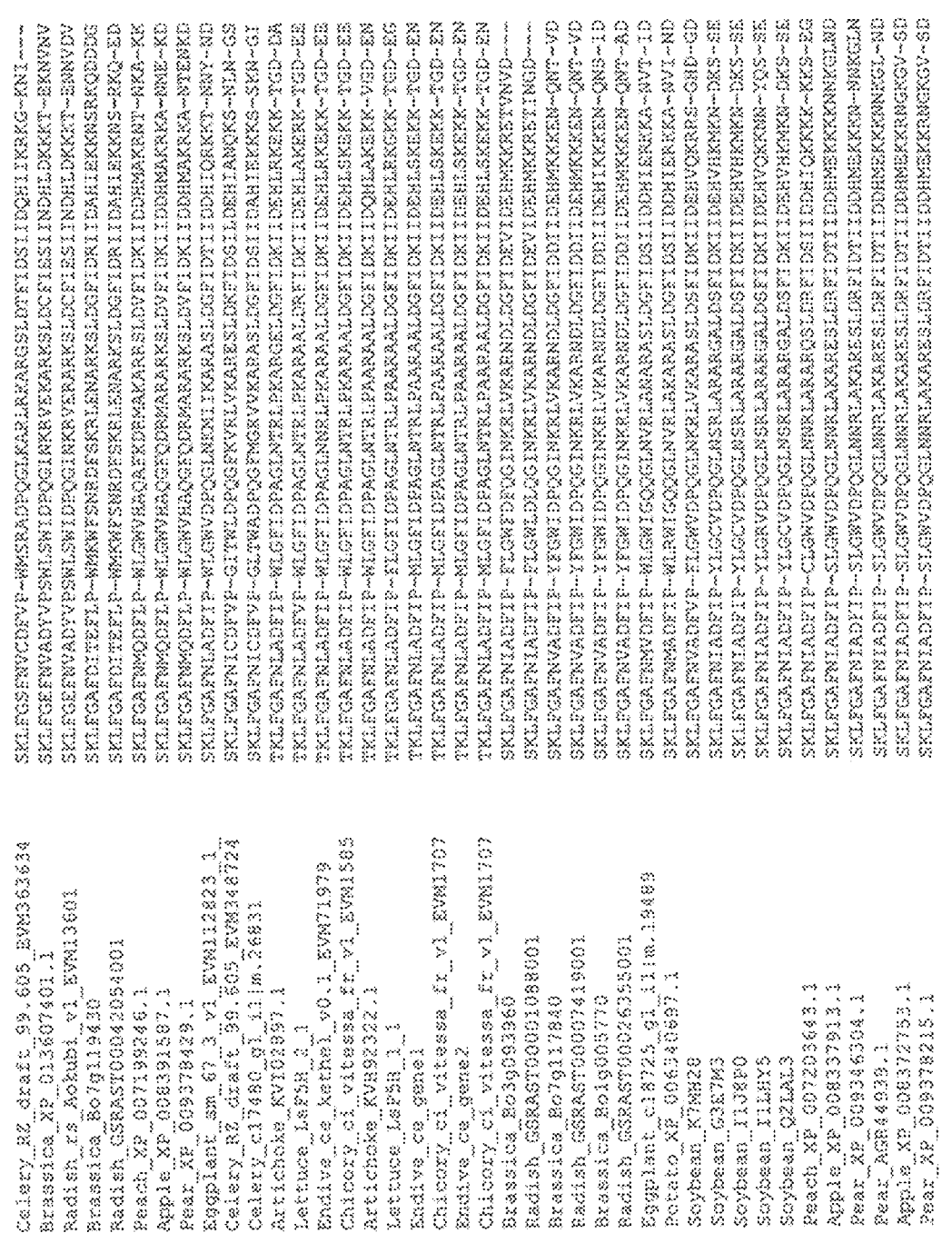
Figure 4:
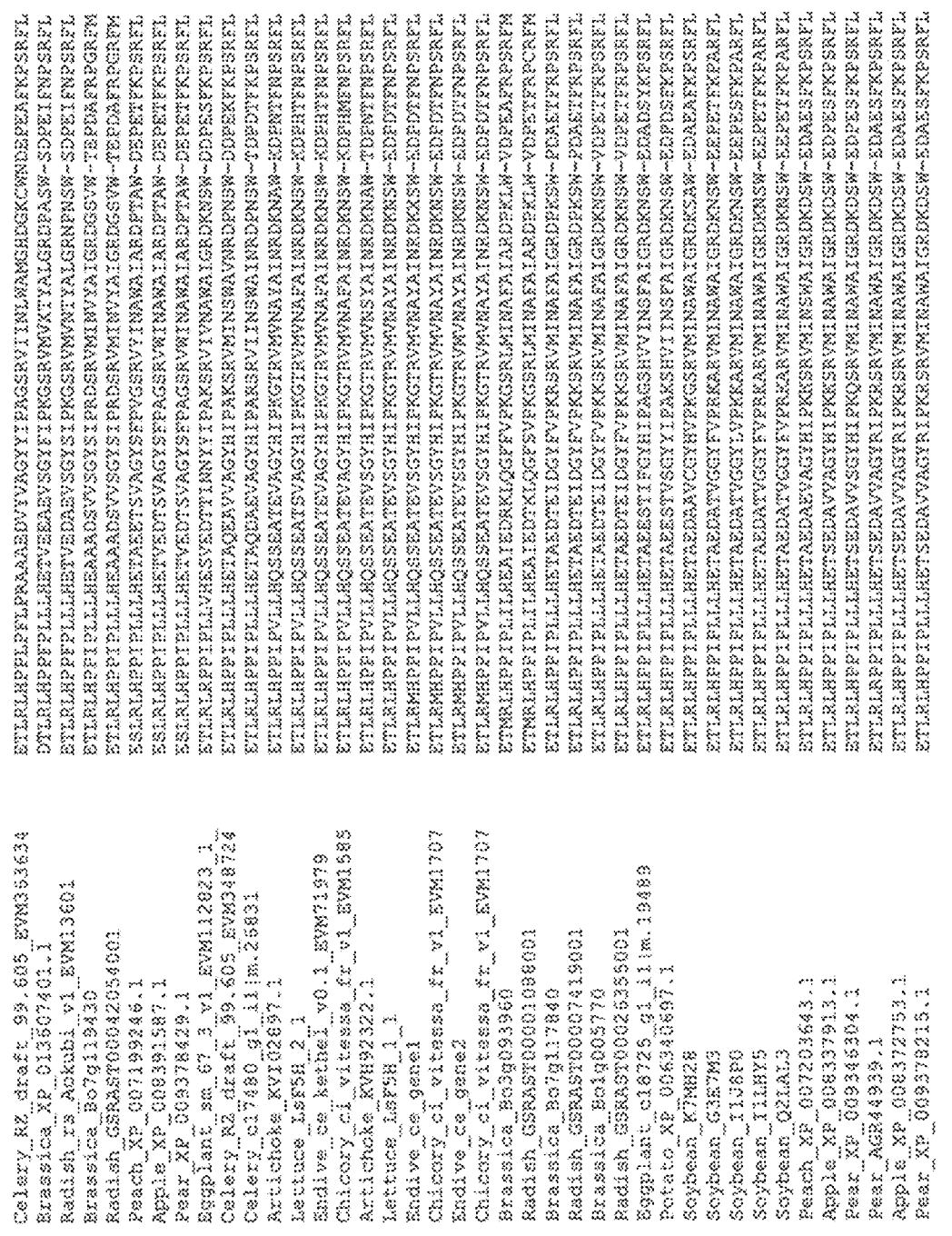

FIG. 4: Alignment of the ortholog proteins having the wild type sequences with the SEQ ID numbers listed in Table 2 (CLUSTAL multiple sequence alignment by MUSCLE (3.8)).

The motifs of Table 1 are highlighted in the sequences.
The following symbols are used below the alignment:
\*—all residues in that column are identical
:—conserved substitutions have been observed
.—semi-conserved substitutions have been observed
--no match (space)

FIG. 5: Example of a scale used for the evaluation of wound-induced surface discoloration on leaf discs represented with a description of each score and a figure of a leaf disc having the given score.

Figure 6:
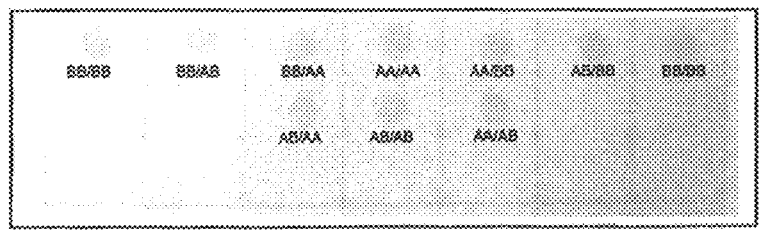
Figure 6:
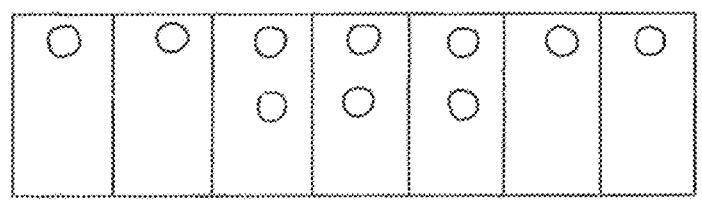
Figure 6:
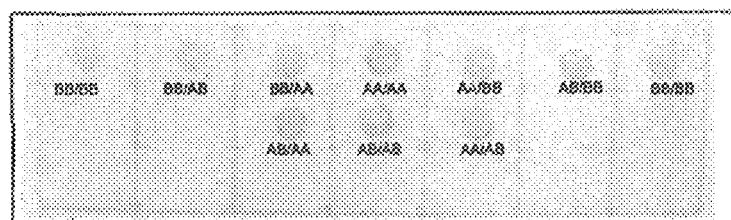
Figure 6:
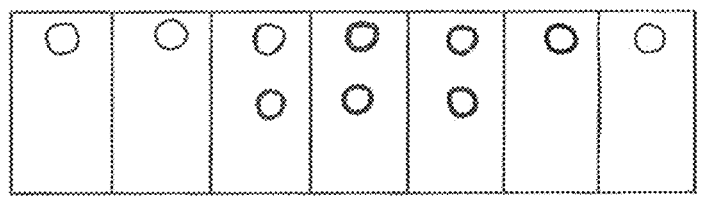
Figure 6:
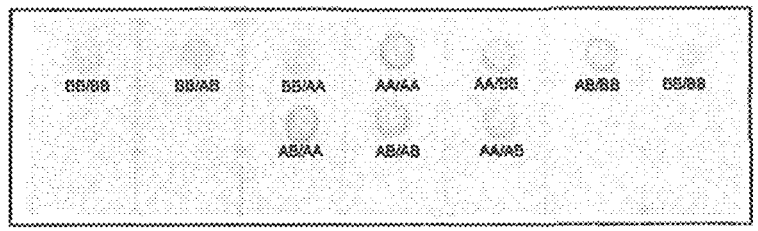
Figure 6:
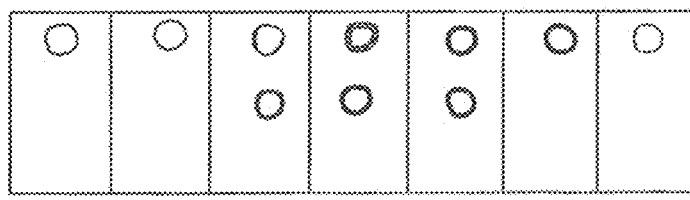
Figure 6:
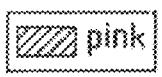
Figure 6:
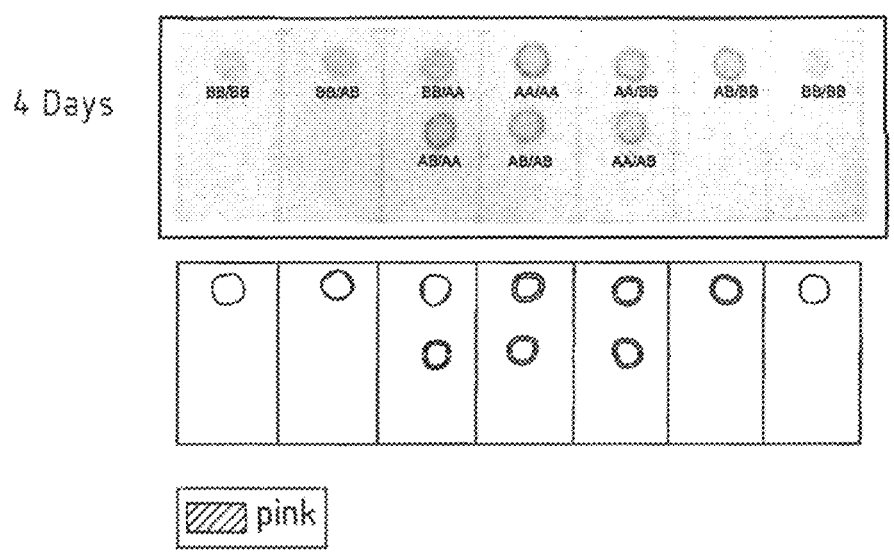

FIG. 6: Leaf discs of a phenotypic test of the segregation analysis of the F2 lines of lettuce plants which may comprise mutation 1 and mutation 3, as described in Example 7. The pictures represent the leaf discs after 1, 2, 3, 4 and 7 days of incubation after sampling.

Figures 1, 7:
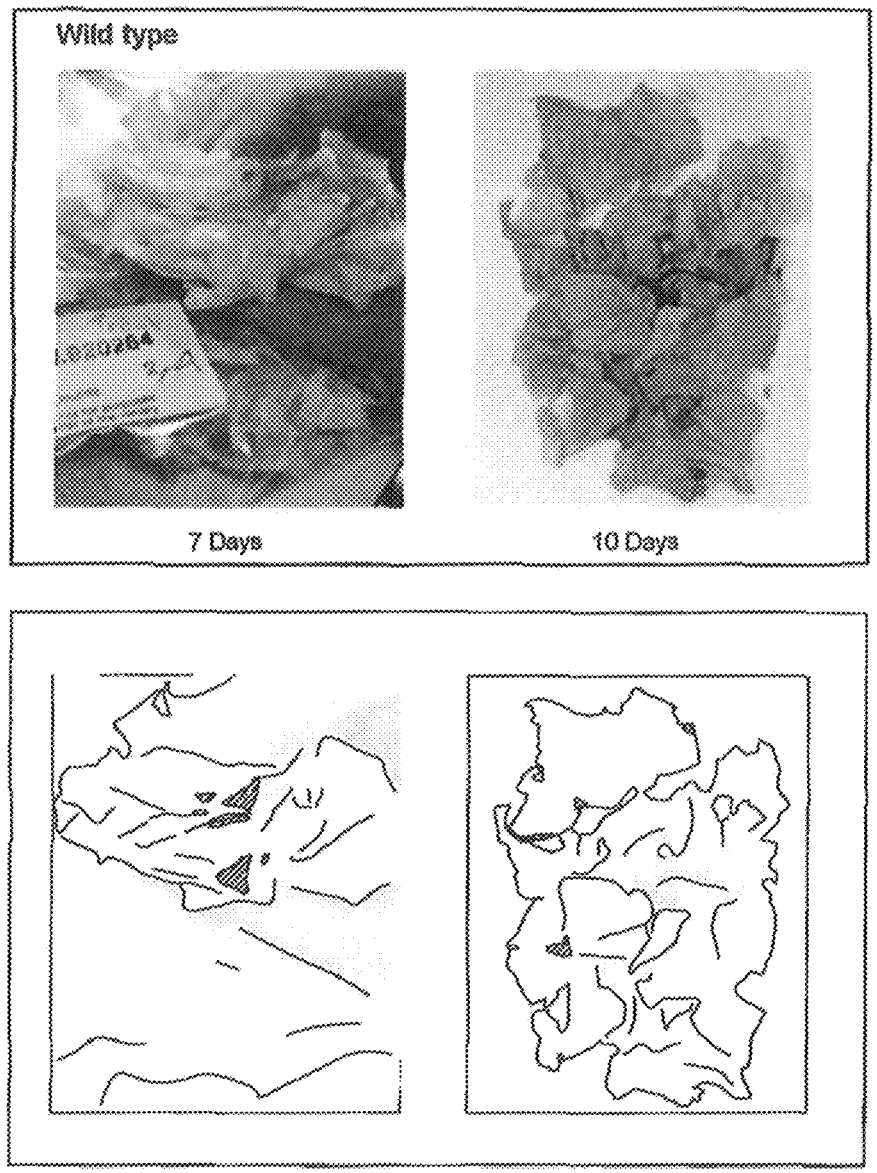

FIG. 7-1-7-3: Phenotypic analysis of whole lettuce heads which may comprise mutation 1 and mutation 3, as described in Example 8.

DEPOSITS

Seeds of lettuce plants (*Lactuca sativa*) of the invention that may comprise a modified F5H gene homolog which lead to reduction of wound-induced surface discoloration, were deposited with the NCIMB Ltd, Ferguson Building, Craibstone Estate, Bucksburn, Aberdeen AB21 9YA, UK on Feb. 19, 2016 under deposit accession the NCIMB Ltd, Ferguson Building, Craibstone Estate, Bucksburn, Aberdeen AB21 9YA, UK on Feb. 19, 2016.

The deposited seeds do not meet the DUS criteria which are required for obtaining plant variety protection, and can therefore not be considered to be plant varieties.

The Deposits with the NCIMB Ltd, Ferguson Building, Craibstone Estate, Bucksburn, Aberdeen AB21 9YA, UK on Feb. 19, 2016, under deposit accession the NCIMB Ltd, Ferguson Building, Craibstone Estate, Bucksburn, Aberdeen AB21 9YA, UK on Feb. 19, 2016 were made pursuant to the terms of the Budapest Treaty. Upon issuance of a patent, all restrictions upon the deposit will be removed, and the deposit is intended to meet the requirements of 37 CFR §§ 1.801-1.809. The deposit will be irrevocably and without restriction or condition released to the public upon the issuance of a patent and for the enforceable life of the patent. The deposit will be maintained in the depository for a period of 30 years, or 5 years after the last request, or for the effective life of the patent, whichever is longer, and will be replaced if necessary during that period.

DETAILED DESCRIPTION OF THE INVENTION

The term "reduced" is always measured in relation to the wound-induced surface discoloration of a control plant or part thereof that has no such modifications to its F5H gene homologs and is therefore a wild type plant which may comprise wild type F5H gene homologs and does not show reduced wound-induced surface discoloration. As used herein, a plant showing a "reduced wound-induced surface discoloration" or a "reduction of wound-induced surface discoloration" is a plant having a reduced wound-induced surface discoloration as compared to the wound induced surface discoloration of a wild type plant. Therefore, an improvement of the reduced wound-induced surface discoloration is defined by a delayed appearance and/or reduced intensity of the discoloration as compared to a plant not which may comprise a modified F5H gene homolog. A reduced intensity of discoloration is visible by a less intense discoloration of the wound surface and/or the discolored surface is smaller as compared to the discoloration and surface of the wound induced surface discoloration of a wild type plant. Ultimately, the wound-induced discoloration is completely absent. A delayed appearance of the discoloration means that the onset of discoloration occurs later in time. The plant thus maintains its fresh appearance longer, which is in fact an increase of shelf life.

The present invention further provides the sequences of the modified F5H gene homologs in order to identify plants which may comprise said modifications that lead to the trait of the invention.

The number of F5H gene homologs within one specific species differs among different plant species. According to the definition of gene homolog described in this application, it was found, that the *Lactuca sativa* plant genome may comprise two F5H gene homologs. One homolog called herein F5H1, is located on chromosome 4 and has the wild type DNA coding sequence (CDS) represented in SEQ ID No: 115 and encodes the wild type F5H1 protein having SEQ ID No: 1. The other lettuce homolog herein called F5H2, is located on chromosome 3 and has the wild type DNA coding sequence represented in SEQ ID No: 116 and encodes the wild type F5H2 protein having SEQ ID No: 2.

It was also found that the genomes of artichocke (*Cynara cardunculus* var. *Scolymus*), rice (*Oryza sativa*), corn (*Zea mays*), peach (*Prunus persica*) and eggplant (*Solanum melongena*) also may comprise two F5H gene homologs the wild type SEQ ID numbers of which are listed in Table 2. The species chicory (*Cichorium intybus*), endive (*Cichorium endivia*), celery and celeriac (*Apium graveolens*) and apple (*Malus domestica*) may comprise three F5H gene homologs the wild type SEQ ID numbers of which are listed in Table 2. The genome of banana (Musa *acuminata*) may comprise four F5H homologs the wild type SEQ ID numbers of which are listed in Table 2. The genomes of soy (*Glycine max*), pear (*Pyrus×bretschneideri*), wheat (*Triticum aestivum*), radish (*Raphanus sativus*) and cabbage and cauliflower (*Brassica oleracea*) may comprise five F5H homologs the wild type SEQ ID numbers of which are listed in Table 2, whereas the genomes of potato (*Solanum tuberosum*) and onion (*Allium cepa*) may comprise one F5H gene homolog in their genomes, the homolog the wild type SEQ ID numbers of which are listed in Table 2.

In a preferred embodiment, the invention relates to plants belonging to the genus *Lactuca*. In particular, the invention relates to a *Lactuca sativa* plant which may comprise two F5H gene homologs that are modified as compared to the nucleotide sequence of the wild type genes (SEQ ID No: 115 and 116), encoding the wild type proteins (SEQ ID No: 1 and 2). Other plants which may comprise a modified F5H gene homolog in their genome such as *Solanum tuberosum*, *Allium cepa*, *Cynara cardunculus* var. *Scolymus*, *Oryza sativa*, *Zea mays*, *Prunus persica*, *Solanum melongena*, *Cichorium intybus*, *Cichorium endivia*, *Apium graveolens*, *Malus domestica*, *Musa acuminate*, *Glycine max*, *Pyrus×bretschneideri*, *Triticum aestivum*, *Raphanus sativus* and *Brassica oleracea*, are also part of the invention.

In another embodiment, the invention relates to a modified F5H gene homolog of a plant belonging to the species *Solanum tuberosum*, *Allium cepa*, *Lactuca sativa*, *Cynara cardunculus* var. *Scolymus*, *Oryza sativa*, *Zea mays*, *Prunus persica*, *Solanum melongena*, *Cichorium intybus*, *Cichorium endivia*, *Apium graveolens*, *Malus domestica*, *Musa acuminate*, *Glycine max*, *Pyrus×bretschneideri*, *Triticum aestivum*, *Raphanus sativus* or *Brassica oleracea*, wherein the modified F5H gene homolog may comprise at least one modification as compared to its wild type sequence and wherein the modification leads to reduced wound-induced surface discoloration to the plant. It is not intended to claim a modified F5H gene of *Arabidopsis thaliana* or the sequence of the NCBI database with the accession no. XP_011028697 (Predicted: cytochrome P450 84A1-like [*Populus euphratica*]), in this application.

In one embodiment, the invention relates to a modified F5H1 gene homolog having the sequence represented by SEQ ID No: 174, that leads to a reduction of wound-induced surface discoloration in comparison to a plant not which may comprise the modified F5H1 gene homolog.

In one embodiment, the invention relates to a modified F5H1 gene homolog having the sequence represented by SEQ ID No: 174 and a modified F5H2 gene homolog having the sequence represented by SEQ ID No: 175, 176, 177, 178 or 179, leading to a reduction of wound-induced surface discoloration in comparison to a plant not which may comprise the modified F5H gene homologs.

The invention relates to a plant which may comprise a modified F5H gene homolog, wherein said gene homolog may comprise a modification as compared to its corresponding wild type F5H gene homolog, wherein the presence of the modified F5H gene homolog in a plant leads to a reduction of wound-induced surface discoloration in comparison to a plant not which may comprise the modified F5H gene homolog.

In one embodiment the invention relates to a plant which may comprise a modified F5H gene homolog, wherein said gene homolog may comprise a modification as compared to its corresponding wild type F5H gene homolog, wherein the presence of the modified F5H gene homolog in a plant leads to a reduction of wound-induced surface discoloration in comparison to a plant not which may comprise the modified F5H gene homolog and wherein the wild type F5H gene sequence is represented by any one of SEQ ID Nos: 58 to 114.

In a particular embodiment the invention relates to a plant which may comprise a modified F5H gene homolog of the invention, wherein the plant is selected from the group consisting of Solanum tuberosum, Allium cepa, Lactuca sativa, Cynara cardunculus var. Scolymus, Oryza sativa, Zea mays, Prunus persica, Solanum melongena, Cichorium intybus, Cichorium endivia, Apium graveolens, Malus domestica, Musa acuminate, Glycine max, Pyrus× bretschneideri, Triticum aestivum, Raphanus sativus and Brassica oleracea, the wild type F5H gene sequence SEQ ID numbers of which are listed in Table 2. It is not intended to claim a Arabidopsis thaliana plant which may comprise a modified F5H gene, in particular the one disclosed in the publication of Meyer et al. in National Academy of Sciences (1996) or in Huang et al. in Planta; an international journal of plant biology (2009), or a plant which may comprise the sequence of the NCBI database with the accession no. XP_011028697 (Predicted: cytochrome P450 84A1-like [Populus euphratica]), in this application.

In another embodiment the invention relates to a plant which may comprise two modified F5H gene homologs, wherein the presence of the modified F5H gene homologs in a plant leads to a reduction of wound-induced surface discoloration in comparison to a plant not which may comprise the modified F5H gene homologs.

In a particular embodiment, the invention relates to a plant which may comprise two modified F5H gene homologs of the invention, wherein the plant is selected from the group consisting of Lactuca sativa, Cynara cardunculus var. Scolymus, Oryza sativa Japonica, Zea mays, Prunus persica, Solanum melongena, Cichorium intybus, Cichorium endivia, Apium graveolens, Malus domestica, Musa acuminate, Glycine max, Pyrus×bretschneideri, Triticum aestivum, Raphanus sativus and Brassica oleracea, the wild type F5H gene sequence SEQ ID numbers of which are listed in Table 2.

In another embodiment the invention relates to a plant which may comprise three modified F5H genes homolog, wherein the presence of the modified F5H gene homologs in a plant leads to a reduction of wound-induced surface discoloration in comparison to a plant not which may comprise the modified F5H gene homologs.

In a particular embodiment, the invention relates to a plant which may comprise three modified F5H gene homologs of the invention, wherein the plant is selected from the group consisting of Cichorium intybus, Cichorium endivia, Apium graveolens, Malus domestica, Musa acuminate, Glycine max, Pyrus×bretschneideri, Triticum aestivum, Raphanus sativus and Brassica oleracea, the wild type F5H gene sequence SEQ ID numbers of which are listed in Table 2.

In another embodiment the invention relates to a plant which may comprise four modified F5H gene homologs, wherein the presence of the modified F5H gene homologs in a plant leads to a reduction of wound-induced surface discoloration in comparison to a plant not which may comprise the modified F5H gene homologs.

In a particular embodiment, the invention relates to a plant which may comprise four modified F5H gene homologs of the invention, wherein the plant is selected from the group consisting of Musa acuminate, Glycine max, Pyrus× bretschneideri, Triticum aestivum, Raphanus sativus and Brassica oleracea, the wild type F5H gene sequence SEQ ID numbers of which are listed in Table 2.

In another embodiment the invention relates to a plant which may comprise five or more modified F5H gene homologs, wherein the presence of the modified F5H gene homologs in a plant leads to a reduction of wound-induced surface discoloration in comparison to a plant not which may comprise the modified F5H gene homologs.

In a particular embodiment, the invention relates to a plant which may comprise five or more modified F5H gene homologs of the invention, wherein the plant is selected from the group consisting of Glycine max, Pyrus× bretschneideri, Triticum aestivum, Raphanus sativus and Brassica oleracea, the wild type F5H gene sequence SEQ ID numbers of which are listed in Table 2.

The invention relates to edible plants such as vegetables, fruits and cereals which may comprise a modified F5H gene homolog, wherein said gene homolog may comprise a modification as compared to its corresponding wild type F5H gene homolog and wherein the presence of the modified F5H gene homolog in the plant leads to a reduction of wound-induced surface discoloration in comparison to a plant not which may comprise the modified F5H gene homolog.

A "plant of the invention" as used herein, is a plant that may comprise a modified F5H gene homolog, wherein said gene homolog may comprise a modification as compared to its corresponding wild type F5H gene homolog and wherein the presence of the modified F5H gene homolog in the plant leads to a reduction of wound-induced surface discoloration in comparison to a plant not which may comprise the modified F5H gene homolog. A plant of the invention is an edible plant such as a vegetable, fruit or cereal. Preferably the plant of the invention is selected from the group consisting of Solanum tuberosum, Allium cepa, Lactuca sativa, Cynara cardunculus var. Scolymus, Oryza sativa, Zea mays, Prunus persica, Solanum melongena, Cichorium intybus, Cichorium endivia, Apium graveolens, Malus domestica, Musa acuminate, Glycine max, Pyrus×bretschneideri, Triticum aestivum, Raphanus sativus and Brassica oleracea, the wild type F5H gene sequence SEQ ID numbers of which are listed in Table 2. Even more preferably the plant of the invention is a lettuce (Lactuca sativa) plant.

The relationship between genes is defined as homologous. In this application "homologous genes" refers to two related genes originating from a common ancestral gene. Homologous sequences are termed "homologs" and this term may be applied to both genes and proteins. The terms "homologous" or "homologs" may be used interchangeably. Homologous genes encode homologous proteins. According to our definition, the wild type sequences of the F5H protein homologs to which the invention relates are listed in Table 2. Moreover, all the F5H protein homologs that were identified during the research leading to the invention, have the five motifs the consensus sequence of which is represented in Table 1 and provided by MAST (Motif Alignment & Search Tool) and MEME (Multiple Em for Motif Elicitation) in their amino acid sequences with a certain degree of variation.

Preferably the F5H protein homologs of the invention may comprise the motifs represented in Table 1 with an identity percentage of at least 54%, more preferably with an identity percentage of at least 60%, even more preferably with an identity percentage of at least 65%, even more preferably with an identity percentage of at least 70%, even more preferably with an identity percentage of at least 75%, even more preferably with an identity percentage of at least 80%, even more preferably with an identity percentage of at least 85%, even more preferably with an identity percentage of at least 90%, even more preferably with an identity percentage of at least 95% and most preferably with an identity percentage of 100%. The consensus sequences of the five motifs are listed in the Table 1 and are highlighted in the alignment of the F5H protein orthologs in FIG. 4.

TABLE 1

Motifs present in all the F5H protein homolog sequences

| Number | Motif |
|---|---|
| 1 SEQ ID No: 169 | IFSNRPATIAISYLTYDRADMAFAHYGPFWRQMRKLC VMKLFSRKRAESW |
| 2 SEQ ID No: 170 | DFKGSNFEFIPFGSGRRSCPGMQLGLYALEMAVAHLL HCFTWELPDGMKP |
| 3 SEQ ID No: 171 | TRDNIKAIIMDVMFGGTETVASAIEWAMTELMHSPED LKRVQQELADVVG |
| 4 SEQ ID No: 172 | YLKCCIKETLRLHPPIPLLLHETAEDCEVAGYHIPKG SRVMINAWAIGRD |
| 5 SEQ ID No: 173 | PYPPGPKGWPIIGNMLMMDQLTHRGLAKLAKQYGGIC HLRMGFLHMVAVS |

"Orthologous genes" are homologous genes present in different species and originated from a common ancestral gene and separated by a speciation event. The terms "orthologous genes" or "orthologs" may be used interchangeably. The present invention thus provides for modifications to F5H gene homologs within a species and F5H gene orthologs of different species, all leading to a reduced wound-induced surface discoloration in said species. The SEQ ID numbers of the wild type sequences of the F5H protein and gene orthologs to which the invention relates are listed in Table 2.

In this application a "gene" may comprise exonic sequences and regulatory sequences such as a promoter sequence, UTR and polyadenylation signals and if present it also may comprise intronic sequences. Modification to a F5H gene homolog creates a "modified gene homolog" by at least one change in the nucleotide sequence of the gene. The terms "modification" and "mutation" may be used interchangeably. Generally, modifications change the expression of the gene and/or the activity of the protein encoded by the gene that may comprise the modification. Modifications to the gene sequence may inhibit gene transcription such that the expression of the modified gene is prevented or reduced or may lead to unstable mRNA. Modifications may also be changes to the sequence of the F5H gene that lead to a reduced level, reduced activity or a complete absence of the encoded protein activity. In some cases, modifications can also lead to an overexpression of the protein that may be responsible for the modified phenotype. A non-limitative list of examples of modifications and techniques in order to modify the genes is described in this application.

As used herein, "wild type" or "WT" refers to the form of an organism as it would occur in nature, in this case a plant not showing a reduction in wound-induced surface discoloration.

As used herein, a wild type gene or gene homolog refers to an unmodified F5H gene as it would occur in a plant not showing a reduction in wound-induced surface discoloration. The wild type plant is used as control plant that does not carry a modified F5H gene homolog and therefore does not show the reduced wound-induced surface discoloration. To be comparable, the plant of the invention that may comprise a modified F5H gene homolog and the wild type plant should be selected from the same type, preferably the same variety, at the same age and be grown under the same conditions.

As used herein, the term "a F5H gene" or "a modified F5H gene" means one or more modified F5H genes. A "plant which may comprise a modified F5H gene homolog" may comprise one or more modified F5H gene homologs.

In this application, the word "trait" refers to the phenotype of the plant. "Trait of the invention", "trait", or "phenotypic trait", "phenotype", "characteristic" may be used interchangeably. The trait of the invention as used herein is the reduced wound-induced surface discoloration as a result of the presence of a modified F5H gene homolog and its corresponding F5H protein.

As used herein the "modified F5H gene homolog of the invention" refers to a F5H homolog that may comprise any modification that leads in a plant to reduced wound-induced surface discoloration. Preferably the modified F5H gene homolog of the invention may comprise a modification represented in Table 3. "Modified F5H gene homolog of the invention", "gene of the invention", "F5H gene of the invention", "F5H gene homolog of the invention" be used interchangeably.

The invention relates to a plant of the invention, wherein reduction of the endogenous level of the F5H1 protein is due to a premature stop codon in the wild-type F5H1 sequences listed in Table 2.

The invention relates to a method for producing a plant exhibition reduced wound-induced surface discoloration, which may comprise reducing the endogenous level of F5H1 protein in the plant.

The invention further relates to a method for producing a plant exhibition reduced wound-induced surface discoloration, which may comprise reducing the endogenous level of F5H1 protein in the plant, wherein the mutation is effected by CRISPR, by a chemical agent, radiation, or a combination thereof.

The modification of a F5H gene can be introduced by means of mutagenesis. Several chemical or physical treatments are known to the person skilled in the art which can be used to induce genetic mutations in plant species like lettuce. Mutagenesis may comprise the random introduction of at least one modification by means of one or more chemical compounds, such as ethyl methanesulphonate (EMS), nitrosomethylurea, hydroxylamine, proflavine, N-methyl-N-nitrosoguanidine, N-ethyl-N-nitrosourea, N-methyl-N-nitro-nitrosoguani dine, diethyl sulphate, ethylene imine, sodium azide, formaline, urethane, phenol and ethylene oxide, and/or by physical means, such as UVirradiation, fast-neutron exposure, X-rays, gamma irradiation, and/or by insertion of genetic elements, such as transposons, T-DNA, retroviral elements. Mutagenesis also may comprise the more specific, targeted introduction of at least one modification by means of homologous recombination, oligonucleotide-based mutation induction, zinc-finger nucleases (ZFNs), transcription activator-like effector nucleases (TALENs) or Clustered Regularly Interspaced Short Palindromic Repeat (CRISPR) systems.

Seeds of the plant to be modified may be treated with a solution containing different concentrations of a mutagen like EMS. EMS alkylates primarily Guanine (G) residues of a DNA strand, which during DNA replication causes pairing with Thymine (T) instead of Cytosine (C). Therefore, GC base pairs change to AT base pairs at a frequency which is determined by the effective dose of EMS and the activity of the mismatch repair system of the plant. The effective dose of EMS depends on the concentration used, the seed size and other physical properties and the time of incubation of the seeds in the EMS solution. The seeds, which have been treated with EMS are typically called M1 seeds. As a consequence of the treatment, the tissues of the M1 seeds contain random point mutations in the genomes of their cells and those present in the subpopulation of cells, which will form the germline tissue (germinal cells) will be transferred to the next generation, which is called M2. Mutations or combinations thereof which are haplo-insufficient thereby causing sterility or which induce embryo lethality will not be transferred to the M2 generation. It should be noted that although most EMS induced mutations and the resulting trait are recessive, there is a possibility that dominant mutations leading to a semi-dominant or dominant trait can occur.

In one embodiment the invention relates to a plant which may comprise a modified F5H gene homolog, wherein said gene homolog is mutated as compared to its corresponding wild type F5H gene homolog, wherein the presence of the modified F5H gene homolog in the plant leads to a reduction of wound-induced surface discoloration in comparison to a plant not which may comprise the modified F5H gene homolog.

In a particular embodiment the invention relates to a plant which may comprise a modified F5H gene homolog, wherein said gene homolog may comprise a man-made mutation as compared to its corresponding wild type F5H gene homolog, wherein the presence of the modified F5H gene homolog in the plant leads to a reduction of wound-induced surface discoloration in comparison to a plant not which may comprise the modified F5H gene homolog.

In one embodiment, the invention relates to a plant or plant part which may comprise a modified F5H1 gene homolog of the invention, wherein the modification leads to a reduction or absence of the protein expression of the F5H1 protein homolog as compared to the expression of the protein produced by the corresponding wild type F5H1 gene homolog.

In a particular embodiment, the invention relates to a Lactuca sativa plant or plant part which may comprise a modified F5H1 gene homolog, wherein the modification leads to a reduction or absence of the protein expression of the F5H1 protein homolog as compared to the expression of the protein produced by the corresponding wild type F5H1 gene homolog.

In one embodiment, the invention relates to a plant or plant part which may comprise a modified F5H2 gene homolog of the invention, wherein the modification leads to a reduction or absence or increase of the protein expression of the F5H2 protein homolog as compared to the expression of the protein produced by the corresponding wild type F5H2 gene homolog.

In a particular embodiment, the invention relates to a Lactuca sativa plant or plant part which may comprise a modified F5H2 gene homolog, wherein the modification leads to a reduction or absence or increase of the protein expression of the F5H2 protein homolog as compared to the expression of the protein produced by the corresponding wild type F5H2 gene homolog.

The invention further relates to a method for producing a plant of the invention, which may comprise reducing the endogenous level of F5H1 protein in the plant, wherein reducing the endogenous level of F5H1 protein in the plant is accomplished by reducing the expression of a F5H1 gene homolog of the plant by gene silencing or RNAi.

The invention also relates to a plant exhibiting reduced wound-induced surface discoloration and showing a reduced F5H1 expression, wherein the reduction or absence is caused by a method described in this application.

When the expression of a modified F5H gene is absent or reduced in the context of this invention, this means that the gene expression leading to the synthesis of a functional protein is prevented and thus absent or that the expression of the modified F5H gene is less than the expression of the wild type F5H gene leading to a lower level of the protein. The said prevention or reduction of gene expression is herein directly or indirectly responsible for the trait of reduced wound-induced surface discoloration.

Gene expression may also be prevented or reduced by preventing the transcription of the gene with for example RNA oligonucleotides or DNA oligonucleotides, or preferably by the expression of a negatively acting transcription factor acting on a F5H gene promoter. Other examples of methods to prevent or reduce the gene expression are the destabilization of the F5H mRNA or transcript, preferably by means of nucleic acid molecules that are complementary to the F5H mRNA or transcript selected from the group consisting of antisense RNA, RNAi molecules, Virus-Induced Gene Silencing (VIGS) molecules, co-suppressor molecules, RNA oligonucleotides or DNA oligonucleotides. Such methods for destabilizing mRNA or transcripts are well known to the person skilled in the art.

Examples of modifications leading to the reduction or absence of the F5H activity are modifications leading to premature stop codons, frame shifts or amino acid substitutions in the encoded protein. The said reduction or absence of the F5H protein activity is herein directly or indirectly responsible for the trait of reduced wound-induced surface discoloration. A reduced activity of the F5H protein may occur for example by introducing one or more mutations into the coding sequence of a F5H gene. Mutation(s) to the F5H gene may affect the biological function of the encoded protein, as compared to F5H protein encoded by a wild type F5H gene where no such mutation(s) is present.

In one embodiment, the invention relates to a plant showing reduced wound-induced surface discoloration which may comprise a modified F5H gene homolog, wherein the modification leads to a reduction or absence of the protein activity of the F5H protein homolog as compared to the activity of the protein produced by the corresponding wild type F5H gene homolog.

In one particular embodiment, the invention relates to a plant showing reduced wound-induced surface discoloration which may comprise a modified F5H1 gene homolog, wherein the modification leads to a reduction or absence of the protein activity of the F5H1 protein homolog as compared to the activity of the protein produced by the corresponding wild type F5H1 gene homolog.

In one embodiment, the invention relates to a plant showing reduced wound-induced surface discoloration which may comprise a modified F5H2 gene homolog, wherein the modification leads to a reduction or absence of the protein activity of the F5H2 protein homolog as compared to the activity of the protein produced by the corresponding wild type F5H2 gene homolog.

The plants of the invention were created by using the mutagenic agent EMS, as described in Example 1. Plants grown from seeds treated one time with the mutagenic agent and selected for their ability to show reduced wound-induced surface discoloration, may comprise at least one mutation in one F5H gene homolog of their genome. In order to introduce modifications to the other F5H gene homologs of the plant, the seeds already carrying one or more modified F5H gene homologs may be treated for additional rounds with the mutagenic agent and selected after each round of treatment with the mutagenic agent for their ability to show reduced wound-induced surface discoloration. For example, a Lactuca sativa plant having two F5H gene homologs in their genome was treated two times with the mutagenic agent EMS in order to introduce a modification in the two F5H gene homologs of this plant.

Modifications to the gene may be recessive, dominant or intermediate. The terms "intermediate and "semi-dominant" may be used interchangeably. In case of a recessive trait, the modification of the gene needs to be present in homozygous state for the trait to be completely visible. Some of the modifications described herein are recessive and thus only confer the reduced wound-induced surface discoloration if both alleles of the gene have the modification. Modifications that are dominant or intermediate can also be visible in heterozygous state. The heterozygous phenotype of an intermediate trait lies between the phenotypes of the homozygous dominant and the homozygous recessive genotypes. These types of modifications are also part of the invention.

Modification in the F5H1 or F5H2 gene homolog may be present in a heterozygous or in a homozygous state. Preferably the modification in the F5H1 gene homolog is present in a homozygous state. The genotype of the plant can be confirmed by using molecular markers. Preferably, the genotype of the plants is confirmed by using the molecular markers described in Example 3.

In one embodiment, the invention relates to a plant which may comprise a F5H gene homolog that may comprise a modification as compared to the corresponding wild type sequence, wherein the modification results in a different phenotype displaying reduced wound-induced surface discoloration.

In one embodiment, the invention relates to a plant which may comprise a F5H gene homolog that may comprise a modification as compared to the corresponding wild type sequence, wherein the modification results in a different phenotype displaying reduced wound-induced surface discoloration as compared to a plant not which may comprise the modified F5H gene homolog.

In the context of this application, the reduced wound-induced discoloration is preferably caused by a modification that was present in the genome of lettuce seeds which were deposited with the NCIMB under accession number NCIMB 42546, NCIMB 42547, NCIMB 42548, NCIMB 42549, NCIMB 42550 and NCIMB 42551. The mutations are described in Table 3.

Seed of seed lot 16E.607_B01 was deposited with the NCIMB under accession number NCIMB 45546. The deposited seeds comprise mutation 1 in the F5H1 gene homolog.

Seed of seed lot 16E.607_B02 was deposited with the NCIMB under accession number NCIMB 42547. The deposited seeds comprise mutation 1 in the F5H1 gene homolog and mutation 2 in the F5H2 gene homolog.

Seed of seed lot 16E.607_B03 was deposited with the NCIMB under accession number NCIMB 42548. The deposited seeds comprise mutation 1 in the F5H1 gene homolog and mutation 3 in the F5H2 gene homolog.

Seed of seed lot 16E.607_B04 was deposited with the NCIMB under accession number NCIMB 42549. The deposited seeds comprise mutation 1 in the F5H1 gene homolog and mutation 4 in the F5H2 gene homolog.

Seed of seed lot 16E.607_B05 was deposited with the NCIMB under accession number NCIMB 42550. The deposited seeds comprise mutation 1 in the F5H1 gene homolog and mutation 5 in the F5H2 gene homolog.

Seed of seed lot 16E.607_B06 was deposited with the NCIMB under accession number NCIMB 42551. The deposited seeds comprise mutation 1 in the F5H1 gene homolog and mutation 6 in the F5H2 gene homolog.

The lettuce F5H1 gene homolog which may comprise mutation 1 is represented by SEQ ID No: 174.

The lettuce F5H2 gene homolog which may comprise mutation 2 is represented by SEQ ID No: 175.

The lettuce F5H2 gene homolog which may comprise mutation 3 is represented by SEQ ID No: 176.

The lettuce F5H2 gene homolog which may comprise mutation 4 is represented by SEQ ID No: 177.

The lettuce F5H2 gene homolog which may comprise mutation 5 is represented by SEQ ID No: 178.

The lettuce F5H2 gene homolog which may comprise mutation 6 is represented by SEQ ID No: 179.

Modifications to a gene may lead to premature stop codons, frame shifts, amino acid substitutions or splice variants in the corresponding protein sequence. The modifications in the protein sequence are the results of substitution, deletions and changes of base pairs in the DNA sequences coding for proteins.

When the modification to the DNA sequence leads to a premature stop codon, the transcription results in a truncated version of the encoded protein. The modification may occur in a region of the protein sequence that contains one or more domains or active sites essential to perform its function and/or to interact with its substrate or other proteins and/or to fold properly into a functional protein.

When the modification to the DNA sequence leads to a frame shift mutation, the protein translation will result in an entirely different amino acid sequence as the WT sequence and often results in a premature stop codon. The translated protein will usually have a different biological function than the WT protein. These modifications are due to the insertion or deletion of a number of base pairs that is not a multiple of three, leading to the shift of the triplet codon encoding the individual amino acid of the protein, relative to the original open-reading frame changing thereby the amino acid sequence of the protein. If the insertion or deletion is a multiple of three it may also lead to a different amino acid sequence as the wild type sequence.

The modification of one or more base pairs in the coding sequence of a DNA sequence can lead to an amino acid change in the encoded protein sequence. Due to the redundancy of the genetic code some mutations lead to the same amino acid, these mutations are called "silent mutations".

Moreover, some amino acid changes are "conservative", i.e. they lead to the replacement of one amino acid by another amino acid with comparable properties, for example similarity in polarity, charge, solubility, hydrophobicity, hydrophilicity or the amphipathic nature of the residues, such that the mutation is unlikely to dramatically influence function of the mature protein and/or change its folding. Other amino acid changes are non-silent, non-conservative amino acid changes and are replacements of an amino acid by another amino acid with different chemical properties in domains that play a role in substrate-recognition, the active site of enzymes, interaction domains or in major structural domains and such amino acid changes may partly or completely destroy the functionality of the encoded protein, without necessarily affecting the expression level of the encoding gene. These types of mutations may lead to detrimental stability, functionality and/or structural effects of the encoded protein. Non-silent and non-conservative amino acid changes can also lead to an over-expression of the encoded protein.

Mutations in the promoter sequence of the F5H gene may also perturb the biological function of the encoded F5H protein, as such mutations may lead to a complete lack of transcription of the gene (e.g. subsequently resulting in a complete absence of the F5H protein), or to a significantly decreased and biologically inadequate level of transcription (e.g. subsequently resulting in a reduced level of the F5H protein) or to an overexpression of the F5H protein (e.g. subsequently resulting in a higher level of the F5H protein).

In the present invention gene expression analysis was performed by measuring the RNA of the F5H1 gene homolog and the F5H2 gene homolog. The analysis showed that the expression of F5H1 and F5H2 is induced upon wounding. The expression of F5H1 seems to start earlier than the expression of F5H2 and the expression of F5H1 seems to be reduced in plants having mutation 1 and optionally a mutation in the F5H2 gene homolog such as mutation 3 or mutation 6.

The invention relates to a plant that may comprise a modified F5H gene homolog wherein said gene homolog may comprise a modification as compared to its corresponding wild type F5H gene homolog, wherein the presence of the modified F5H gene homolog in a plant leads to a reduction of wound-induced surface discoloration in comparison to a plant not which may comprise the modified F5H gene homolog. The invention relates to a plant which may comprise a modified F5H gene of the invention, wherein the modification leads to a premature stop codon.

The invention relates to a *Lactuca sativa* plant which may comprise a first modified F5H gene homolog called F5H1, the wild type of which has SEQ ID No. 115, and optionally a second modified F5H gene homolog called F5H2, the wild type of which has SEQ ID No. 116.

The invention also relates to a *Lactuca sativa* plant, wherein the modified F5H1 gene homolog is homozygously present and the modified F5H2 gene homolog is either heterozygously or homozygously present.

The invention further relates to a *Lactuca sativa* plant, wherein the modified F5H1 gene may comprise a premature stop codon.

The invention further relates to a *Lactuca sativa* plant, wherein the modified F5H1 gene may comprise a premature stop codon that is caused by a mutation C>T at position 370 of SEQ ID No: 115.

In one embodiment, the invention relates to another plant of the invention listed in FIG. 4 and the premature stop codon is caused by a mutation at a position that corresponds to position 370 of SEQ ID No: 115 in *Lactuca sativa*.

The invention further relates to a *Lactuca sativa* plant, which may comprise a first modified F5H gene homolog called F5H1, the wild type of which has SEQ ID No. 115, and optionally a second modified F5H gene homolog called F5H2, the wild type of which has SEQ ID No. 116, wherein the modified F5H2 gene encodes a protein having one or more amino acid substitutions.

The invention further relates to a *Lactuca sativa* plant, which may comprise a first modified F5H gene homolog called F5H1, the wild type of which has SEQ ID No. 115, and optionally a second modified F5H gene homolog called F5H2, the wild type of which has SEQ ID No. 116, wherein the modified F5H2 gene encodes a protein having an amino acid substitution of Threonine to Isoleucine at position 154 of the encoded F5H2 protein of SEQ ID No: 2, and/or an amino acid substitution of Glycine to Glutamic acid at position 165 of the encoded F5H2 protein of SEQ ID No: 2, and/or an amino acid substitution of Serine to Phenylalanine at position 308 of the encoded F5H2 protein of SEQ ID No: 2, and/or an amino acid substitution of Glycine to Glutamic acid at position 434 of the encoded F5H2 protein of SEQ ID No: 2, and/or an amino acid substitution of Glycine to Glutamic acid at position 436 of the encoded F5H2 protein of SEQ ID No: 2.

The invention further relates to a *Lactuca sativa* plant, which may comprise a first modified F5H gene homolog called F5H1, the wild type of which has SEQ ID No. 115, and optionally a second modified F5H gene homolog called F5H2, the wild type of which has SEQ ID No. 116, wherein the amino acid substitution of Threonine to Isoleucine at position 154 of the encoded F5H2 protein is the result of a nucleotide change C>T at position 461 of SEQ ID No: 116, the amino acid substitution of Glycine to Glutamic acid at position 165 of the encoded F5H2 protein is the result of a nucleotide change G>A at position 494 of SEQ ID No: 116, the amino acid substitution of Serine to Phenylalanine at position 308 of the encoded F5H2 protein is the result of a nucleotide change C>T at position 923 of SEQ ID No: 116, the amino acid substitution of Glycine to Glutamic acid at position 434 of the encoded F5H2 protein is the result of a nucleotide change G>A at position 1301 of SEQ ID No: 116 and the amino acid substitution of Glycine to Glutamic acid at position 436 of the encoded F5H2 protein is the result of a nucleotide change G>A at position 1307 of SEQ ID No: 116.

In one embodiment the invention relates to another plant of the invention listed in FIG. 4 and the amino acid substitution is at a position that corresponds to the position in *Lactuca sativa*.

The invention also relates to a *Lactuca sativa* plant, which may comprise a modified F5H1 gene, which gene may comprise a premature stop codon and a F5H2 gene which may comprise an amino acid substitution.

The invention relates to a *Lactuca sativa* plant, which may comprise a modified F5H1 gene, which gene may comprise a premature stop codon and a F5H2 gene which may comprise an amino acid substitution, wherein the premature stop codon in the F5H1 gene is caused by a mutation C>T at position 370 of SEQ ID No: 115 and the amino acid substitution in the F5H2 gene selected from Threonine to Isoleucine at position 154 of the encoded F5H2 protein is the result of a nucleotide change C>T at position 461 of SEQ ID No: 116, the amino acid substitution of Glycine to Glutamic acid at position 165 of the encoded F5H2 protein is the result of a nucleotide change G>A at position 494 of SEQ ID No:

116, the amino acid substitution of Serine to Phenylalanine at position 308 of the encoded F5H2 protein is the result of a nucleotide change C>T at position 923 of SEQ ID No: 116, the amino acid substitution of Glycine to Glutamic acid at position 434 of the encoded F5H2 protein is the result of a nucleotide change G>A at position 1301 of SEQ ID No: 116 or the amino acid substitution of Glycine to Glutamic acid at position 436 of the encoded F5H2 protein is the result of a nucleotide change G>A at position 1307 of SEQ ID No: 116.

In one embodiment, the invention relates to a *Lactuca sativa* plant of the invention, which may comprise a modified F5H1 gene, which gene may comprise a premature stop codon and a F5H2 gene which may comprise an amino acid substitution, wherein the premature stop codon in the F5H1 gene is caused by a mutation C>T at position 370 of SEQ ID No: 115 and the amino acid substitution in the F5H2 gene Glycine to Serine at position 159 of the encoded F5H2 protein is the result of a nucleotide change G>A at position 475 of SEQ ID No: 116.

In particular, the invention relates to a *Lactuca sativa* plant that may comprise one modification to the F5H1 gene homolog wherein the modification leads to a premature stop in the coding sequence of the lettuce F5H1 gene in combination with a modification to the F5H2 gene wherein the modification leads to an amino acid substitution. When both mutations, the mutation leading to a premature stop codon in the F5H1 gene homolog and the amino acid substitution in the F5H2 protein sequence, are carried by a plant the effect is enhanced and the plant which may comprise these mutations shows an delayed wound-induced surface discoloration. Therefore, a plant which may comprise a modified F5H1 gene homolog and a modified F5H2 gene homolog shows delayed wound-induced surface discoloration, as compared to a plant which may comprise only a modified F5H1 gene homolog.

A segregation analysis is performed with the F2 plants resulting from a cross of a plant showing reduced wound induced surface discoloration and which may comprise a mutation in the F5H1 gene homolog and a mutation in the F5H2 gene homolog in a homozygous state with a wild type plant that does not comprise a modified F5H gene homolog. The resulting F1 plants are selfed and the phenotype of the F2 plants grown from the obtained seeds is analyzed. The F2-plants may comprise the mutation(s) in a homozygous state, heterozygous state or do not may comprise any mutation. The results of the segregation analysis of the trait of the invention shows that in order to show reduced wound induced surface discoloration the plant may comprise the mutation 1 on the F5H1 homolog ($C_{370}$>$T_{370}$ in the F5H1 gene homolog) preferably in a homozygous state. Plants that may comprise the mutation 1 in the F5H1 homolog in a homozygous state and a mutation in the F5H2 gene homolog such as the mutation 3 in a homozygous or heterozygous state show a reduced wound-induced surface discoloration as compared to plants which may comprise only mutation 1 in the F5H1 gene homolog.

In one embodiment the invention relates to a plant which may comprise a modification to the F5H1 gene homolog of a *Lactuca sativa* plant as indicated in Table 3.

In yet a further embodiment the invention relates to a combination of mutation 1 of the F5H1 gene homolog and one or more of mutation 2, 3, 4, 5 and 6 of the F5H2 gene homolog of a *Lactuca sativa* plant as indicated in Table 3.

The invention further relates to a modified F5H gene homolog that confers reduced wound-induced surface discoloration to a plant.

The invention further relates to the use of a modified F5H gene homolog for the development of a plant exhibiting reduced wound-induced surface discoloration.

The modified F5H gene homologs that have been identified in the course of this research and described in this application, are certainly not the only modifications to the F5H gene homologs that would lead to the trait of the invention and the invention should thus not be limited to the specific modifications described in this application but extends to all other modifications to the gene and/or protein leading to reduced wound-induced surface discoloration. By using methods described herein or known in the art, the skilled person is very well capable of introducing the described or other mutations that have the same or a similar effect in lettuce or in every other plant which may comprise a F5H gene homolog.

By using a phenotypic screening test as described herein it can be established whether the wound-induced surface discoloration is reduced compared to the discoloration of a WT plant. The phenotypic test can be used to detect reduced wound-induced surface discoloration in lettuce and in other crops that have a F5H gene homolog. The modification of a gene homolog leading to reduced wound-induced surface discoloration can be used for any plant that may be subject to discoloration, but it is in particular useful for vegetables or fruits.

Moreover, the skilled person is also capable of detecting other F5H gene homologs other than the homologs characterized in this application. The skilled person may detect other gene homologs in the crops to which relates the invention or in other crops that are not described in this application. After detecting these other homologs, the skilled person is capable of modifying their sequences by using methods described in this application or known in the art. By modifying other F5H gene homologs the reduction of the wound-induced surface discoloration may be enhanced.

Amino acid substitutions may occur in regions of the protein that do not significantly affect the protein structure, function and stability. However, amino acid substitutions that occur at a position within a well conserved domain may affect the expression level or activity level of the protein. Multiple sequence alignments between F5H protein orthologs reveals highly conserved positions that may be relevant to the stability, function and/or structure of the F5H protein. It was found according to the invention, that F5H protein homologs may comprise five conserved motifs as listed in Table 1 and highlighted in the protein alignment (FIG. 4), were identified in all the species. Non-conservative amino acid changes within these conserved regions may disrupt the stability, functionality, and/or structure of the encoded F5H protein. However, modifications outside these motifs may also have an effect the stability, functionality, and/or structure of the encoded F5H protein.

More in particular, the substitution of a highly conserved Glycine residue at position 434 in the lettuce F5H2 protein (SEQ ID No: 2), which is encoded by $G_{1300}G_{1301}A_{1302}$ of the lettuce F5H2 DNA sequence (SEQ ID No: 116), with a Glutamic acid residue, which is encoded by $G_{1300}A_{1301}A_{1302}$, leads in combination with mutation 1 to reduced wound-induced surface discoloration to a plant as compared to a wild type plant and to a reduced wound-induced surface discoloration as compared to a plant which may comprise only mutation 1.

More in particular, the substitution of a highly conserved Serine residue at position 308 in the lettuce F5H2 protein (SEQ ID No: 2), which is encoded by $T_{922}C_{923}T_{924}$ of the lettuce F5H2 DNA sequence (SEQ ID No: 116), with a Phenylalanine residue, which is encoded by $T_{922}T_{923}T_{924}$, leads in combination with mutation 1 to reduced wound-induced surface discoloration to a plant as compared to a wild type plant and to a reduced wound-induced surface discoloration as compared to a plant which may comprise only mutation 1.

More in particular, the substitution of a highly conserved Glycine residue at position in the lettuce F5H2 protein (SEQ ID No: 2), which is encoded by $G_{1306}G_{1307}A_{1308}$ of the lettuce F5H2 DNA sequence (SEQ ID No: 116), with a Glutamic acid residue, which is encoded by $G_{1306}A_{1307}A_{1308}$, leads in combination with mutation 1 to reduced wound-induced surface discoloration to a plant as compared to a wild type plant and to a reduced wound-induced surface discoloration as compared to a plant which may comprise only mutation 1.

The present invention is broadly applicable to all plant species and crops that carry at least one functional F5H gene homolog in their genome. The F5H genes present in other plant species are called "gene orthologs" and are coding for F5H proteins having the same or a similar function. Identification of F5H orthologues, i.e. F5H genes in other species, can be performed in many crops, methods for which are known in the art. In the present research, orthologs of the F5H gene were identified in other crops by comparing the lettuce F5H protein sequences (SEQ ID No: 1 and 2) against sequences of other plant genomes using a Basic Local Alignment Search Tool (BLAST) program. The best hits per species were identified as candidate F5H orthologous genes, listed in Table 2. Multiple sequence alignments of the protein sequences using CLUSTAL confirmed that the candidate genes were orthologous F5H genes (FIG. 4). Once the DNA sequences of orthologous F5H genes and their encoded F5H proteins are known, this information may be used to modulate or modify the proteins encoded by said genes using the methods described herein or known by the person skilled in the art.

The invention thus also relates to a plant of the species *Solanum tuberosum, Allium cepa, Cynara cardunculus* var. *Scolymus, Oryza sativa, Zea mays, Prunus persica, Solanum melongena, Cichorium intybus, Cichorium endivia, Apium graveolens, Malus domestica, Musa acuminate, Glycine max, Pyrus×bretschneideri, Triticum aestivum, Raphanus sativus* and *Brassica oleracea*, which may comprise one or more modified F5H gene homologs in its genome which modified homologs lead to reduced wound-induced surface discoloration.

The invention relates to a method for selecting a plant showing reduced wound-induced surface discoloration, wherein the method may comprise screening a plant or a population of plants for the presence of a modified F5H gene homolog leading to reduced wound-induced surface discoloration in a plant, optionally applying a phenotypic test to identify plants showing reduced wound-induced surface discoloration, and selecting a plant showing reduced wound-induced surface discoloration.

Methods used to detect and select plants that show a reduction of the wound-induced discoloration are for example a phenotypic test such as the test described and illustrated in Example 2 and/or the use of molecular markers as characterized in Example 3. Both methods may be used to directly or indirectly detect and select the plants exhibiting a reduction of the wound-induced surface discoloration and which may comprise a modified F5H gene in the F1 or in any further generation resulting from a cross with a parent plant showing the reduced wound-induced discoloration and which may comprise a modified F5H gene homolog.

The trait of the invention can phenotypically be determined in a leaf disc test as described in Example 2 may comprise the step of inducing a wound by taking for example a leaf disc of the plant. The shape of the sample is not limited to discs, but rather a piece of the leaves with a wound, regardless of the shape. The sample of the leaf is incubated between wetted filter papers moistened with buffer MES and after an incubation of three, five and ten days at 7.5° C., it is compared to a leaf sample taken from a control plant that does not carry a modified F5H gene homolog in its genome, i.e. a wild type plant, that was incubated for the same time, under the same conditions.

The presence and the intensity of wound-induced surface discoloration on the different leaf disc samples can be evaluated on an appropriate scale in order to compare them. The skilled person can use a scale with any subdivision. In the phenotypic analysis described in Example 2 the wound-induced surface discoloration appears as a pink colored ring around the edges of the leaf disc. When the color is saturated and the wound-induced surface discoloration is very strong, the discoloration may appear red to very dark red. An example of scale is from 9 to 0, wherein 9 means that no discoloration on the edges is visible, score 8 means that the leaf disc has a very slight pink discoloration around the edges, score 5 means that the leaf disc has a thin ring of red/pink discoloration around the edges, score 2 means that the leaf disc has a darker and thicker ring of red/pink discoloration around the edges as compared to a leaf disc having score 9, 8, 7, 6, 5, 4 or 3 and score 0 means that the leaf disc has a very dark red and thick ring of discoloration around the edges. An example of each score is represented in FIG. 5. The scale described in this application is an example of a scale that could be used to attribute a score to a leaf disc of a plant to test and to another plant in order to compare them and to identify the reduced wound-induced surface discoloration. The scoring of the leaf discs should be preferably done by the one person.

In order to identify the reduced wound-induced surface discoloration, the score of the plant to test should be compared to the score of the wild type plant at for example 3, 5 and 10 days after sampling. Leaf discs taken from plants that show a reduced wound-induced surface discoloration have a score that is higher than the score of leaf discs of a wild type plant at the same day of incubation. Preferably the leaf discs taken from a plant showing a reduced wound-induced surface discoloration have score 9 or score 8. A plant which may comprise a modified F5H1 gene and a modified F5H2 gene has a higher score than a plant which may comprise a modified F5H1 gene homolog alone at the same day of incubation. To be comparable the leaf disc test of the plants should be performed under the same conditions with plants grown under the same conditions.

Alternatively, the wound-induced surface discoloration can also be determined by cutting the plant or a part thereof and storing this cut part until it shows wound-induced surface discoloration. The evaluation of the wound-induced surface discoloration can be performed by reproducing the usual storage conditions of the plants. The plants at mature stage are harvested and cut into pieces. For lettuce plants the cutting method may depend on the lettuce variety used to perform the test. The plant pieces are washed and stored at 5-6° C. in a cool cell in plastic bags. After 1, 2, 3, 4, 7 and 10 days after washing the presence and the intensity of the wound-induced surface discoloration are evaluated. In order to detect the discoloration, the cut leaf pieces were compared to the cut leaf pieces of the WT plant. The presence and the intensity of the wound-induced surface discoloration is detectable by the presence and intensity of a pink discoloration on the cutting edges that can be evaluated by using a scale from 9 to 4, wherein 9 means that no signs of wound-induced surface discoloration are visible, 8 means that first little traces of pink discoloration (nearly not visible, only a glow) are visible, 7 means the pink discoloration is appearing on some edges, 6 means that the pink discoloration is visible on all cutting edges, 5 means that a strong pink discoloration is visible on all cutting edges and 4 means that a dark pink discoloration is visible on all cutting edges. A plant showing reduced wound-induced surface discoloration has a higher score than a wild type plant. To be comparable the phenotypical analysis of whole lettuce heads should be performed under the same conditions with plants grown under the same conditions.

The invention relates to a molecular marker for detecting in the genome of a plant a mutation causative of reduced wound-induced surface discoloration in said plant or part thereof, wherein the marker is a mutation in any of the wild type sequences, the SEQ ID numbers of which are shown in Table 2.

The invention relates to a molecular marker for detecting in the genome of a plant a mutation causative of reduced wound-induced surface discoloration in said plant or part thereof, wherein the mutation is a nucleotide change of C>T at position 370 of SEQ ID No: 115.

The invention relates to a molecular marker for detecting in the genome of a plant a mutation causative of reduced wound-induced surface discoloration in said plant or part thereof, wherein the mutation is an amino acid substitution from Threonine to Isoleucine at position 154 of the encoded protein as a result of a change C>T at position 461 of SEQ ID No: 116, and/or an amino acid substitution of Glycine to Glutamic acid at position 165 of the encoded protein as a result of a change G>A at position 494 of SEQ ID No: 116 and/or an amino acid substitution of Serine to Phenylalanine at position 308 of the encoded protein as a result of a change C>T at position 923 of SEQ ID No: 116, and/or an amino acid substitution of Glycine to Glutamic acid at position 434 of the encoded protein as a result of a change G>A at position 1301 of SEQ ID No: 116, and/or an amino acid substitution Glycine to Glutamic acid at position 436 of the encoded protein as a result of a change G>A SNP at position 1307 of SEQ ID No: 116.

The invention further relates to the use of a molecular marker as described herein, to identify or develop a plant showing reduced wound-induced surface discoloration, or develop other markers linked to a modified F5H gene homolog of the invention.

The invention also relates to a method for identifying molecular markers linked to the reduced wound-induced surface discoloration of a plant, which may comprise:

a) isolating DNA from a plant and from one or both parents of said plant;

b) screening for molecular markers in a region of said DNA at or near sequence corresponding to SEQ ID Nos: 174, 175, 176, 177, 178 or 179; and c) determining co-inheritance of said markers with the reduced wound-induced phenotype from one or both parents of said plant.

The invention also relates to the use of a molecular marker to identify a modification in a F5H gene homolog that leads to a reduced wound-induced surface discoloration, or to develop other markers linked to a modified F5H gene homolog of the invention. A molecular marker is based upon the modification to the F5H gene homologs that underlies the trait. A non-exclusive list of suitable molecular markers is provided in this application. The person skilled in the art is familiar with creating and using them for detecting and selecting plants with a modified F5H gene homolog causative of reduced wound-induced surface discoloration during breeding.

During the research that led to the present invention a number of EMS induced SNP mutations were identified in the two F5H gene homologs of *Lactuca sativa*. One of the identified SNPs in F5H1 resulted in a stop codon in the protein and five of the identified SNPs in F5H2 resulted in an amino acid change in the protein sequence. The SNPs can be used as markers for detecting the presence of a modified F5H gene homolog in the genome of a plant.

In a particular embodiment, one suitable molecular marker is the $C_{370}>T_{370}$ SNP in the F5H1 gene of lettuce (*Lactuca sativa*) represented in Table 5 (Example 3).

In a particular embodiment, one suitable molecular marker is the $C_{461}>T_{461}$ SNP in the F5H2 gene of lettuce (*Lactuca sativa*) represented in Table 6 (Example 3).

In a particular embodiment, one suitable molecular marker is the $G_{494}>A_{494}$ SNP in the F5H2 gene of lettuce (*Lactuca sativa*) represented in Table 6 (Example 3).

In a particular embodiment, one suitable molecular marker is the $C_{923}>T_{923}$ SNP in the F5H2 gene of lettuce (*Lactuca sativa*) represented in Table 6 (Example 3).

In a particular embodiment, one suitable molecular marker is the $G_{1301}>A_{1301}$ SNP in the F5H2 gene of lettuce (*Lactuca sativa*) represented in Table 6 (Example 3).

In a particular embodiment, one suitable molecular marker is the $G_{1307}>A_{1307}$ SNP in the F5H2 gene of lettuce (*Lactuca sativa*) represented in Table 6 (Example 3).

The invention relates to the molecular markers and the use of these markers to identify the modified F5H gene homologs leading to reduced wound-induced surface discoloration in all the plants which may comprise a F5H gene homolog. The SNP markers mentioned above are particularly suitable for use in *Lactuca sativa*.

The invention relates to a method of determining the presence of a modified F5H gene homolog in a plant of the invention, which may comprise the steps of obtaining a sample of nucleic acids from said plant, comparing said nucleic acids to a sample of nucleic acids obtained from a reference plant which may comprise the wild type F5H gene homolog, and detecting a polymorphism between the two nucleic acid samples, wherein the detected polymorphism is indicative of the presence of said modified homolog.

Preferably, the wild type F5H gene homolog is any one of the sequences of which the SEQ ID numbers are listed in Table 2.

A modified F5H gene may be introduced into any other genetic background of the same or a different species. The plant lacking the modification may have other desired traits. For sexually compatible plants the introgression can be achieved through crossing and/or backcrossing and selecting in the first generation in which the reduced wound-induced surface discoloration is detectable. Crossing can optionally be followed by embryo rescue techniques or other techniques that result in a successful combination and introgression, which techniques are known to the person skilled in the art. The parent plants may be plants grown directly from the deposited seeds or progeny plants from the seed or a progeny plant from seeds that are identified to have the trait of the invention by other means.

When a trait is dominant monogenic, it can be introgressed into another plant in only one generation (F1). When a trait is recessive and/or involves more than one gene, introgression may encompass a breeding process that takes multiple generations. Introgression is used herein to describe the entire process. For a dominant trait, the selection of the plants carrying the modification can start in the F1 or any further generation resulting from a cross between a plant with the desired trait and a plant without this trait. For a recessive trait, the selection with a phenotypic test and/or with the use of molecular markers is started in the F2 or any further generation resulting from a cross or alternatively from a backcross.

In a particular embodiment, one or more modified lettuce F5H gene homologs can be introgressed from a *Lactuca sativa* plant carrying the modified lettuce F5H gene homolog into a *Lactuca sativa* plant lacking modified lettuce F5H gene homologs using standard breeding techniques.

The invention further relates to propagation material suitable for producing a plant that may comprise one or more modified F5H genes in its genome and exhibits reduced wound-induced discoloration. In one embodiment, the propagation material is formed by parts of the plant that are suitable for sexual reproduction, in particular a microspore, pollen, ovary, ovule, embryo sac and egg cell. In another embodiment, the propagation material is formed by parts suitable for vegetative reproduction, in a particular a microspore, pollen, ovary, ovule, embryo, embryo sac, egg cell, cutting, root, root tip, hypocotyl, cotyledon, stem, leaf, flower, anther, seed, meristematic cell, protoplast and a cell, or a tissue culture thereof.

The invention also relates to a plant grown or regenerated from the said propagation material, which plant may comprise in its genome one or more modified F5H genes as defined herein, providing the plant with reduced wound-induced surface discoloration.

In particular, the plant produced from the propagation material may comprise the modified F5H gene homolog as found in lettuce plants grown from seeds, and of which representative seed was deposited with the NCIMB under accession numbers NCIMB 42546, NCIMB 42547, NCIMB 42548, NCIMB 42549, NCIMB 42550 and NCIMB 42551.

The invention also relates to the use of a plant of the invention that may comprise a modified F5H gene, which provides to a plant the reduction of wound-induced surface discoloration, in plant breeding to confer this trait.

The invention relates to a method for producing a plant showing reduced wound-induced surface discoloration which may comprise:
a) crossing a plant which may comprise a modified F5H gene homolog of claim 1, with another plant;
b) optionally performing one or more rounds of selfing and/or crossing; and
c) optionally selecting after each round of selfing or crossing for a plant that may comprise said reduced wound-induced surface discoloration.

In one embodiment the plant is phenotypically selected and/or selected by use of molecular markers.

In one aspect the invention relates to a method for production of a plant that shows reduced wound-induced surface discoloration, which may comprise
a) crossing a plant which may comprise a modified F5H gene homolog of the invention that leads to the trait with another plant;
b) selfing the resulting F1 for obtaining F2 plants;
c) selecting plants that have the trait in the F2;
d) optionally performing one or more additional rounds of selfing or crossing, and subsequently selecting, for a plant which may comprise/showing the trait of the invention.

In one aspect, the invention relates to a method for production of a plant that shows reduced wound-induced surface discoloration, which may comprise
a) crossing a plant which may comprise a modified F5H gene homolog of the invention that leads to the trait with another plant;
b) optionally backcrossing the resulting F1 with the preferred parent;
c) selecting for plants that have the trait in the F2;
d) optionally performing one or more additional rounds of selfing or crossing, and subsequently selecting, for a plant which may comprise the trait.

The invention additionally provides a method of introducing another desired trait into a plant which has the trait of the invention, which may comprise:
a) crossing a plant that may comprise a modified F5H gene homolog of the invention and that shows reduced wound-induced surface discoloration, with a second plant that may comprise a desired trait to produce F1 progeny;
b) selecting an F1 progeny plant that may comprise said trait of reduced wound-induced surface discoloration and the desired trait;
c) crossing the selected F1 progeny with either parent, to produce backcross progeny;
d) selecting backcross progeny which may comprise the desired trait and showing reduced wound-induced surface discoloration; and
e) optionally repeating steps c) and d) one or more times in succession to produce selected fourth or higher backcross progeny that may comprise a modified F5H gene homolog and that shows reduced wound-induced surface discoloration. The invention includes a plant produced by this method.

In one embodiment the selection for plants that show reduced wound-induced surface discoloration is done in the F1 or any further generation by using the markers described in Example 3. In another aspect selection for the trait of the invention is started in the F2 of a cross or alternatively of a backcross. Selection of plants in the F2 can be done phenotypically as well as by using the said marker(s) which directly or indirectly detect the modified F5H gene underlying the trait.

In one embodiment selection for plants that show reduced wound-induced surface discoloration is started in the F3 or a later generation.

In one embodiment the plant which may comprise a F5H gene homolog of the invention is a plant of an inbred line, a hybrid, a doubled haploid, or of a segregating population.

The invention further provides a method for the production of a plant that shows reduced wound-induced surface discoloration by using a doubled haploid generation technique to generate a doubled haploid line which may comprise the said trait.

The invention further relates to hybrid seed that can be grown into a plant that shows reduced wound-induced surface discoloration and to a method for producing such hybrid seed which may comprise crossing a first parent plant with a second parent plant and harvesting the resultant hybrid seed, wherein said first parent plant and/or said second parent plant is the plant as claimed.

The invention further relates to a method for producing a hybrid plant that that shows reduced wound-induced surface discoloration, which may comprise crossing a first parent plant with a second parent plant and harvesting the resultant hybrid seed, of which the first parent plant and/or the second parent plant is a plant that shows reduced wound-induced surface discoloration, and growing said hybrid seeds into hybrid plants that show reduced wound-induced surface discoloration.

The invention also relates to a method of producing a hybrid plant seed which may comprise crossing a first parent plant with a second parent plant and harvesting the resultant plant seed, wherein said first parent plant and/or said second parent plant may comprise a modified F5H gene homolog of the invention.

The invention also relates to a method for the production of a plant that shows reduced wound-induced surface discoloration, which may comprise growing the plant from a seed that may comprise a modified F5H gene homolog in its genome that leads to the trait of reduced wound-induced surface discoloration. The seeds are suitably seeds of which a representative sample was deposited with the NCIMB under accession numbers NCIMB 42546, NCIMB 42547, NCIMB 42548, NCIMB 42549, NCIMB 42550 and NCIMB 42551.

The invention also relates to a method for seed production which may comprise growing plants from seeds of which a representative sample was deposited with the NCIMB under accession numbers NCIMB 42546, NCIMB 42547, NCIMB 42548, NCIMB 42549, NCIMB 42550 and NCIMB 42551, allowing the plants to produce seeds, and harvesting those seeds. Production of the seeds is suitably done by crossing or selfing.

The invention relates to a method for the production of a plant that shows reduced wound-induced surface discoloration by tissue culture using a plant of the invention as described herein as the source of the tissue.

The invention furthermore relates to a method for the production of a plant that shows reduced wound-induced surface discoloration by vegetative reproduction of parts of a plant of the invention as described herein.

In one embodiment, the invention relates to a method for the production of a plant that shows reduced wound-induced surface discoloration by using a method for genetic modification to introgress the said trait into the plant from a plant of the invention. Genetic modification may comprise transgenic modification or transgenesis, using a gene from a non-crossable species or a synthetic gene, and cisgenic modification or cisgenesis, using a natural gene, coding for an (agricultural) trait, from the crop plant itself or from a sexually compatible donor plant.

The invention also relates to a breeding method for the development of plants that show reduced wound-induced surface discoloration wherein germplasm which may comprise said trait is used. Representative seed of said plant which may comprise the modified F5H gene homolog and being representative for the germplasm was deposited with the NCIMB under accession numbers NCIMB 42546, NCIMB 42547, NCIMB 42548, NCIMB 42549, NCIMB 42550 and NCIMB 42551.

In a further embodiment the invention relates to a method for the production of a plant that shows reduced wound-induced surface discoloration wherein progeny or propagation material of a plant which may comprise the modified F5H gene homolog conferring said trait is used as a source to introgress the said trait into another plant. Representative seed of said plant which may comprise the modified F5H gene homolog was deposited with the NCIMB under accession numbers NCIMB 42546, NCIMB 42547, NCIMB 42548, NCIMB 42549, NCIMB 42550 and NCIMB 42551.

The invention provides preferably a plant showing reduced wound-induced surface discoloration, which plant is obtainable by any of the methods herein described and/or familiar to the skilled person.

In the course of breeding a new plant carrying a modified F5H gene homolog, desirable agronomic traits may be introduced into plant independently of the modified F5H gene. As used herein, "desirable traits" include but are not limited to e.g. improved yield, leaf shape, leaf size, leaf number, leaf color, seed number, seed size, plant vigor, plant height, bolting, and resistance to one or more diseases or disease causing organisms. Any one of these desirable traits may be combined with a modified F5H gene homolog.

The invention further relates to a method for producing an agronomically elite plant that shows the reduced wound-induced surface discoloration of the invention, which may comprise introgressing a modified F5H gene homolog into a agronomically elite plant. This can be achieved by methods described in this application or known in the art. The invention also includes a plant produced by this method.

In yet a further embodiment the agronomically elite plant of the invention is an inbred line or a hybrid.

As used herein, a plant of an inbred line is a plant of a population of plants that is the result of three or more rounds of selfing, or backcrossing; or which plant is a double haploid. An inbred line may e.g. be a parent line used for the production of a commercial hybrid.

As used herein, a hybrid plant is a plant which is the result of a cross between two different plants having different genotypes. More in particular, a hybrid plant is the result of a cross between plants of two different inbred lines, such a hybrid plant may e.g. be a plant of an $F_1$ hybrid variety.

In one embodiment the plant of the invention, i.e. a plant which may comprise the modified F5H gene of the invention, is an agronomically elite plant.

In the context of this invention an agronomically elite plant is a plant having a genotype that as a result of directed crossing and selection by human intervention results into an accumulation of distinguishable and desirable agronomic traits which allow a producer to harvest a product of commercial significance.

The invention also relates to a food product which may comprise a part of a plant of the invention. The food product may comprise one or more harvested parts of plants of the invention, to food products which may comprise harvested leaves of plants of the invention, either in natural or in processed form, and to a container which may comprise one or more plants of the invention in a growth substrate for harvest of leaves from the lettuce plant in a domestic environment. The harvested part or food product may be, or comprise the head and/or part of a plant such as leaves of a plant of the invention. The food product or harvested part, may have undergone one or more processing steps. Such a processing step might comprise but is not limited to any one of the following treatments or combinations thereof: cutting, washing, or a salad mixture which may comprise parts of the plant of the invention such as leaves. The processed form that is obtained is also part of the invention. All the food products and harvested parts carry in their genome modified F5H gene homolog of the invention.

The invention relates to a part of a plant of the invention, wherein the part is a leaf, a whole head of a plant, a fruit, an inflorescence, a seeds, a curd, a stem, a tuber, a bulb or a root, optionally in processed form.

The invention further relates to a seed capable of developing into a plant of the invention.

The invention also relates to a seed of a plant of the invention, wherein the seed may comprise a modified F5H gene homolog in its genome.

The invention further relates to a cell of a plant of the invention, which cell may comprise a modified F5H gene in its genome and provides the plant with reduced wound-induced discoloration. Such cell may be either isolated from or may be part of a plant or parts thereof.

The invention also relates to a cell of a lettuce plant (*Lactuca sativa*), which lettuce plant shows reduced wound-induced surface discoloration as found in a lettuce plant grown from seed as deposited with the NCIMB on 19 Feb. 2016 under NCIMB and having one of the accession numbers NCIMB 42546, NCIMB 42547, NCIMB 42548, NCIMB 42549, NCIMB 42550, or NCIMB 42551.

The invention also relates to a cell of a plant, which plant may comprise a modified F5H gene and shows reduced wound-induced surface discoloration.

The invention also relates to a cell of a plant that may comprise a modified F5H gene and that shows reduced wound-induced surface discoloration, which plant is obtainable by crossing a plant which may comprise a modified F5H gene and selecting for a plant that shows a reduced wound-induced surface discoloration.

The invention also relates to cell of a lettuce plant (*Lactuca sativa*), which lettuce plant shows reduced wound-induced surface discoloration as found in a lettuce plant grown from seed as deposited with the NCIMB on 19 Feb. 2016 under NCIMB and having one of the accession numbers NCIMB 42546, NCIMB 42547, NCIMB 42548, NCIMB 42549, NCIMB 42550, or NCIMB 42551, which lettuce plant is obtainable by crossing a lettuce plant with a lettuce plant grown from seed as deposited with the NCIMB on 19 Feb. 2016 under NCIMB and having one of the accession numbers NCIMB 42546, NCIMB 42547, NCIMB 42548, NCIMB 42549, NCIMB 42550, or NCIMB 42551, and selecting for a lettuce plant that shows a reduced wound-induced surface discoloration.

The invention also relates to the use of seeds that were deposited under NCIMB under accession numbers NCIMB 42546, NCIMB 42547, NCIMB 42548, NCIMB 42549, NCIMB 42550 and NCIMB 42551, for developing plants showing reduced wound-induced surface discoloration into another lettuce plant (*Lactuca sativa*).

The invention also relates to the use of the seeds of which a representative sample was deposited under NCIMB under accession numbers NCIMB 42546, NCIMB 42547, NCIMB 42548, NCIMB 42549, NCIMB 42550 and NCIMB 42551 for transferring the reduced wound-induced surface discoloration trait into another agronomically valuable lettuce plant.

The invention also relates to the use of a plant that may comprise a modified F5H gene homolog of the invention and shows reduced wound-induced surface discoloration, as a crop.

In particular the invention relates to the use of a lettuce plant (*Lactuca sativa*) that exhibits reduced wound-induced surface discoloration, as found in a lettuce plant grown from seed as deposited with the NCIMB on 19 Feb. 2016 and having one of the accession numbers NCIMB 42546, NCIMB 42547, NCIMB 42548, NCIMB 42549, NCIMB 42550 or NCIMB 42551, as a crop.

The invention also relates to the use of a plant that may comprise a modified F5H gene homolog of the invention and shows reduced wound-induced surface discoloration, as a source of seed.

In particular the invention relates to the use of a lettuce plant (*Lactuca sativa*) that exhibits reduced wound-induced surface discoloration, as found in a lettuce plant grown from seed as deposited with the NCIMB on 19 Feb. 2016 and having one of the accession numbers NCIMB 42546, NCIMB 42547, NCIMB 42548, NCIMB 42549, NCIMB 42550 or NCIMB 42551, as a source of seed.

The invention also relates to the use of a plant that may comprise a modified F5H gene homolog of the invention and shows reduced wound-induced surface discoloration, as a source of propagation.

In particular the invention relates to the use of a lettuce plant (*Lactuca sativa*) that exhibits reduced wound-induced surface discoloration, as found in a lettuce plant grown from seed as deposited with the NCIMB on 19 Feb. 2016 and having one of the accession numbers NCIMB 42546, NCIMB 42547, NCIMB 42548, NCIMB 42549, NCIMB 42550 or NCIMB 42551, as a source of propagating material.

The invention also relates to the use of a plant that may comprise a modified F5H gene homolog of the invention and shows reduced wound-induced surface discoloration, for consumption.

In particular the invention relates to the use of a lettuce plant (*Lactuca sativa*) that exhibits reduced wound-induced surface discoloration, as found in a lettuce plant grown from seed as deposited with the NCIMB on 19 Feb. 2016 and having one of the accession numbers NCIMB 42546, NCIMB 42547, NCIMB 42548, NCIMB 42549, 42550 or NCIMB 42551, for consumption. The invention also relates to the use of a modified F5H gene homolog of the invention, for conferring reduced wound-induced surface discoloration to a plant.

In particular, the invention relates to the use of a F5H gene homolog as found in seeds that were deposited with the NCIMB on 19 Feb. 2016 and having one of the accession numbers NCIMB 42546, NCIMB 42547, NCIMB 42548, NCIMB 42549, NCIMB 42550 or NCIMB 42551, for conferring reduced wound-induced surface discoloration to a lettuce plant (*Lactuca sativa*).

The invention relates to the use of a plant as a recipient of modified F5H gene homologs of the invention.

In particular, the invention relates to the use of a lettuce plant (*Lactuca sativa*) as found in seeds that were deposited with the NCIMB on found in seeds that were deposited with the NCIMB on 19 Feb. 2016 and having one of the accession numbers NCIMB 42546, NCIMB 42547, NCIMB 42548, NCIMB 42549, NCIMB 42550 or NCIMB 42551.

The invention also relates to the use of modified F5H gene of the invention for conferring reduced wound-induced surface discoloration to a plant.

In particular, the invention relates to the use of a modified F5H gene homolog as found in seeds that were deposited with the NCIMB on 19 Feb. 2016 and having one of the accession numbers NCIMB 42546, NCIMB 42547, NCIMB 42548, NCIMB 42549, NCIMB 42550, or NCIMB 42551, conferring reduced wound-induced surface discoloration to a lettuce plant (*Lactuca sativa*).

The invention also relates to the use of seeds that were deposited with the NCIMB on 19 Feb. 2016 and having one of the accession numbers NCIMB 42546, NCIMB 42547, NCIMB 42548, NCIMB 42549, NCIMB 42550, or NCIMB 42551, for transferring reduced wound-induced surface discoloration into another lettuce plant (*Lactuca sativa*).

TABLE 2

Overview of the F5H orthologs. The overview indicates which SEQ ID Nos are linked to which plant species.

| Name | Species | Common Name | Detail | SEQ ID No |
|---|---|---|---|---|
| Lettuce_LsF5H_1_1 | *Lactuca sativa* | Lettuce | Protein | 1 |
| Lettuce_LsF5H_2_1 | *Lactuca sativa* | Lettuce | Protein | 2 |
| Endive_ce_gene1 | *Cichorium endivia* | Endive | Protein | 3 |
| Endive_ce_gene2 | *Cichorium endivia* | Endive | Protein | 4 |
| Endive_ce_kethel_v0.1_EVM71979 | *Cichorium endivia* | Endive | Protein | 5 |
| Chicory_ci_vitessa_fr_v1_EVM170737 | *Cichorium intybus* | Chicory | Protein | 6 |
| Chicory_ci_vitessa_fr_v1_EVM170780 | *Cichorium intybus* | Chicory | Protein | 7 |
| Chicory_ci_vitessa_fr_v1_EVM158591 | *Cichorium intybus* | Chicory | Protein | 8 |
| Celery_RZ_draft_99.605_EVM363634 | *Apium graveolens* | Celery/Celariac | Protein | 11 |
| Celery_RZ_draft_99.605_EVM348724 | *Apium graveolens* | Celery/Celariac | Protein | 12 |
| Celery_c17480_g1_i1|m.26831 | *Apium graveolens* | Celery/Celariac | Protein | 13 |
| Brassica_Bo1g005770 | *Brassica oleracea* | Cabbage/Cauliflower | Protein | 14 |
| Brassica_Bo7g117840 | *Brassica oleracea* | Cabbage/Cauliflower | Protein | 15 |
| Brassica_Bo7g119430 | *Brassica oleracea* | Cabbage/Cauliflower | Protein | 16 |
| Brassica_Bo3g093960 | *Brassica oleracea* | Cabbage/Cauliflower | Protein | 17 |
| Brassica_XP_013607401.1 | *Brassica oleracea* | Cabbage/Cauliflower | Protein | 18 |
| Eggplant_c18725_g1_i1|m.19489 | *Solanum melongena* | Eggplant | Protein | 19 |
| Eggplant_sm_67_3_v1_EVM112823_1_ | *Solanum melongena* | Eggplant | Protein | 20 |
| Potato_XP_006340697.1 | *Solanum tuberosum* | Potato | Protein | 21 |
| Apple_XP_008372753.1 | *Malus domestica* | Apple | Protein | 22 |
| Apple_XP_008337913.1 | *Malus domestica* | Apple | Protein | 23 |
| Apple_XP_008391587.1 | *Malus domestica* | Apple | Protein | 24 |
| Pear_XP_009378215.1 | *Pyrus x bretschneideri* | Pear | Protein | 25 |
| Pear_XP_009338655.1 | *Pyrus x bretschneideri* | Pear | Protein | 26 |
| Pear_AGR44939.1 | *Pyrus x bretschneideri* | Pear | Protein | 27 |
| Pear_XP_009346304.1 | *Pyrus x bretschneideri* | Pear | Protein | 28 |
| Pear_XP_009378429.1 | *Pyrus x bretschneideri* | Pear | Protein | 29 |
| Peach_XP_007199246.1 | *Prunus persica* | Peach | Protein | 30 |
| Peach_XP_007203643.1 | *Prunus persica* | Peach | Protein | 31 |
| Banana_XP_009384541.1 | *Musa acuminata* | Banana | Protein | 32 |
| Banana_XP_009384087.1 | *Musa acuminata* | Banana | Protein | 33 |
| Banana_XP_009411495.1 | *Musa acuminata* | Banana | Protein | 34 |
| Banana_XP_009403617.1 | *Musa acuminata* | Banana | Protein | 35 |
| Wheat_A0A077RPS5 | *Triticum aestivum* | Wheat | Protein | 36 |
| Wheat_W5A2I1 | *Triticum aestivum* | Wheat | Protein | 37 |
| Wheat_W5B6W3 | *Triticum aestivum* | Wheat | Protein | 38 |
| Wheat_A0A077RQ37 | *Triticum aestivum* | Wheat | Protein | 39 |
| Wheat_W5AC21 | *Triticum aestivum* | Wheat | Protein | 40 |
| Rice_Os03g0112900 | *Oryza sativa* | Rice | Protein | 41 |
| Rice_Os10g0512400 | *Oryza sativa* | Rice | Protein | 42 |

TABLE 2-continued

Overview of the F5H orthologs. The overview indicates which SEQ ID Nos are linked to which plant species.

| Name | Species | Common Name | Detail | SEQ ID No |
|---|---|---|---|---|
| Maize_A0A0B4J2X1 | Zea mays | Corn | Protein | 43 |
| Maize_B4FWF9 | Zea mays | Corn | Protein | 44 |
| Soybean_G3E7M3 | Glycine max | Soy | Protein | 45 |
| Soybean_I1J8P0 | Glycine max | Soy | Protein | 46 |
| Soybean_Q2LAL3 | Glycine max | Soy | Protein | 47 |
| Soybean_K7MH28 | Glycine max | Soy | Protein | 48 |
| Soybean_I1LHY5 | Glycine max | Soy | Protein | 49 |
| Artichoke_KVI02897.1 | Cynara cardunculus var. scolymus | Artichoke | Protein | 50 |
| Artichoke_KVH92322.1 | Cynara cardunculus var. scolymus | Artichoke | Protein | 51 |
| Radish_GSRAST00026355001 | Raphanus sativus | Radish | Protein | 52 |
| Radish_GSRAST00007419001 | Raphanus sativus | Radish | Protein | 53 |
| Radish_GSRAST00001088001 | Raphanus sativus | Radish | Protein | 54 |
| Radish_GSRAST00042054001 | Raphanus sativus | Radish | Protein | 55 |
| Radish_rs_Aokubi_v1_EVM13601 | Raphanus sativus | Radish | Protein | 56 |
| Onion_AC.SP3B.Locus_5396.1.10 | Allium cepa | Onion | Protein | 57 |
| Lettuce_LsF5H_1_1 | Lactuca sativa | Lettuce | Genomic DNA | 58 |
| Lettuce_LsF5H_2_1 | Lactuca sativa | Lettuce | Genomic DNA | 59 |
| Endive_ce_gene1 | Cichorium endivia | Endive | Genomic DNA | 60 |
| Endive_ce_gene2 | Cichorium endivia | Endive | CDS | 61 |
| Endive_ce_kethel_v0.1_EVM71979 | Cichorium endivia | Endive | Genomic DNA | 62 |
| Chicory_ci_vitessa_fr_v1_EVM170737 | Cichorium intybus | Chicory | Genomic DNA | 63 |
| Chicory_ci_vitessa_fr_v1_EVM170780 | Cichorium intybus | Chicory | Genomic DNA | 64 |
| Chicory_ci_vitessa_fr_v1_EVM158591 | Cichorium intybus | Chicory | Genomic DNA | 65 |
| Celery_RZ_draft_99.605_EVM363634 | Apium graveolens | Celery/Celariac | Genomic DNA | 68 |
| Celery_RZ_draft_99.605_EVM348724 | Apium graveolens | Celery/Celariac | Genomic DNA | 69 |
| Celery_c17480_g1_i1|m.26831 | Apium graveolens | Celery/Celariac | CDS | 70 |
| Brassica_Bo1g005770 | Brassica oleracea | Cabbage/Cauliflower | Genomic DNA | 71 |
| Brassica_Bo7g117840 | Brassica oleracea | Cabbage/Cauliflower | Genomic DNA | 72 |
| Brassica_Bo7g119430 | Brassica oleracea | Cabbage/Cauliflower | Genomic DNA | 73 |
| Brassica_Bo3g093960 | Brassica oleracea | Cabbage/Cauliflower | Genomic DNA | 74 |
| Brassica_XP_013607401.1 | Brassica oleracea | Cabbage/Cauliflower | Genomic DNA | 75 |
| Eggplant_c18725_g1_i1|m.19489 | Solanum melongena | Eggplant | CDS | 76 |
| Eggplant_sm_67_3_v1_EVM112823_1_ | Solanum melongena | Eggplant | Genomic DNA | 77 |
| Potato_XP_006340697.1 | Solanum tuberosum | Potato | Genomic DNA | 78 |
| Apple_XP_008372753.1 | Malus domestica | Apple | Genomic DNA | 79 |
| Apple_XP_008337913.1 | Malus domestica | Apple | Genomic DNA | 80 |
| Apple_XP_008391587.1 | Malus domestica | Apple | Genomic DNA | 81 |
| Pear_XP_009378215.1 | Pyrus x bretschneideri | Pear | Genomic DNA | 82 |
| Pear_XP_009338655.1 | Pyrus x bretschneideri | Pear | Genomic DNA | 83 |
| Pear_AGR44939.1 | Pyrus x bretschneideri | Pear | CDS | 84 |

TABLE 2-continued

Overview of the F5H orthologs. The overview indicates which SEQ ID Nos are linked to which plant species.

| Name | Species | Common Name | Detail | SEQ ID No |
|---|---|---|---|---|
| Pear_XP_009346304.1 | *Pyrus x bretschneideri* | Pear | Genomic DNA | 85 |
| Pear_XP_009378429.1 | *Pyrus x bretschneideri* | Pear | Genomic DNA | 86 |
| Peach_XP_007199246.1 | *Prunus persica* | Peach | Genomic DNA | 87 |
| Peach_XP_007203643.1 | *Prunus persica* | Peach | Genomic DNA | 88 |
| Banana_XP_009384541.1 | *Musa acuminata* | Banana | Genomic DNA | 89 |
| Banana_XP_009384087.1 | *Musa acuminata* | Banana | Genomic DNA | 90 |
| Banana_XP_009411495.1 | *Musa acuminata* | Banana | Genomic DNA | 91 |
| Banana_XP_009403617.1 | *Musa acuminata* | Banana | Genomic DNA | 92 |
| Wheat_A0A077RPS5 | *Triticum aestivum* | Wheat | Genomic DNA | 93 |
| Wheat_W5A2I1 | *Triticum aestivum* | Wheat | Genomic DNA | 94 |
| Wheat_W5B6W3 | *Triticum aestivum* | Wheat | Genomic DNA | 95 |
| Wheat_A0A077RQ37 | *Triticum aestivum* | Wheat | Genomic DNA | 96 |
| Wheat_W5AC21 | *Triticum aestivum* | Wheat | Genomic DNA | 97 |
| Rice_Os03g0112900 | *Oryza sativa Japonica* | Rice | Genomic DNA | 98 |
| Rice_Os10g0512400 | *Oryza sativa Japonica* | Rice | Genomic DNA | 99 |
| Maize_A0A0B4J2X1 | *Zea mays* | Corn | Genomic DNA | 100 |
| Maize_B4FWF9 | *Zea mays* | Corn | Genomic DNA | 101 |
| Soybean_G3E7M3 | *Glycine max* | Soy | Genomic DNA | 102 |
| Soybean_I1J8P0 | *Glycine max* | Soy | Genomic DNA | 103 |
| Soybean_Q2LAL3 | *Glycine max* | Soy | Genomic DNA | 104 |
| Soybean_K7MH28 | *Glycine max* | Soy | Protein | 105 |
| Soybean_I1LHY5 | *Glycine max* | Soy | Genomic DNA | 106 |
| Artichoke_KVI02897.1 | *Cynara cardunculus var. scolymus* | Artichoke | Genomic DNA | 107 |
| Artichoke_KVH92322.1 | *Cynara cardunculus var. scolymus* | Artichoke | Genomic DNA | 108 |
| Radish_GSRAST00026355001 | *Raphamus sativus* | Radish | Genomic DNA | 109 |
| Radish_GSRAST00007419001 | *Raphamus sativus* | Radish | Genomic DNA | 110 |
| Radish_GSRAST00001088001 | *Raphamus sativus* | Radish | Genomic DNA | 111 |
| Radish_GSRAST00042054001 | *Raphamus sativus* | Radish | Genomic DNA | 112 |
| Radish_rs_Aokubi_v1_EVM13601 | *Raphamus sativus* | Radish | Genomic DNA | 113 |
| Onion_AC.SP3B.Locus_5396.1.10 | *Allium cepa* | Onion | Genomic DNA | 114 |

TABLE 3

Modifications of the F5H1 and F5H2 gene homologs of Lactuca sativa

| Mutation number | F5H gene | Nt. change | Pos. CDS Nt. change | Codon change | AA change | AA change Pos. |
|---|---|---|---|---|---|---|
| 1 | F5H1 | C > T | 370 | $C_{370}A_{371}A_{372}$ > $T_{370}A_{371}A_{372}$ | Gln > stop | 124 |
| 2 | F5H2 | C > T | 461 | $A_{460}C_{461}C_{462}$ > $A_{460}T_{461}C_{462}$ | Thr > Ile | 154 |
| 3 | F5H2 | G > A | 494 | $G_{493}G_{494}A_{495}$ > $G_{493}A_{494}A_{495}$ | Gly > Glu | 165 |
| 4 | F5H2 | C > T | 923 | $T_{922}C_{923}T_{924}$ > $T_{922}T_{923}T_{924}$ | Ser > Phe | 308 |
| 5 | F5H2 | G > A | 1301 | $G_{1300}G_{1301}A_{1302}$ > $G_{1300}A_{1301}A_{1302}$ | Gly > Glu | 434 |
| 6 | F5H2 | G > A | 1307 | $G_{1306}G_{1307}A_{1308}$ > $G_{1306}A_{1307}A_{1308}$ | Gly > Glu | 436 |

(AA = Amino acid, Nt = Nucleotide, CDS = DNA coding sequence, Pos. = Position)

Table 3 shows the F5H1 and F5H2 mutations and the effect on the encoded F5H1 and F5H2 protein sequences. Positions are as in the sequences of Lactuca sativa, SEQ ID No: 115 (F5H1 CDS sequence wild type), SEQ ID No: 116 (F5H2 CDS sequence wild type), SEQ ID No: 1 (F5H1 protein sequence wild type) and SEQ ID No: 2 (F5H2 protein sequence wild type).

SEQUENCES

Protein

SEQ ID No: 1
>Lettuce_LsF5H_1_1
MESLQIPIAFYAIIAILTFFFLSWVRRKPLPPGPMGWPIIGNMLMMDQLTHRGL
ARLAEKYGGILHLKMGFSHTIAVSSPEMARIILQEKDNIFANRPATIAITYLTYNGVDLAF
ANYGPFWRQMRKLCVMKLFSRKRAESWDSVRDEVDTMVKATAINSGTPVNLGELVFG
LTHDIIYRAAFGSISHEGKEEFIRILQEYTKLFGAFNLADFIPFLGFIDPAGLNTRLPAARA
ALDGFIDKIIDEHLRKGKKTGDEGLDNDMVDEMLAFYSEEGKVNEGGDLQNAINLTRD
NIKAIIMDVMFGGTETVASAIEWAMTELMHTPEALKRVQQEMANVVGLDRRVEESDLE
KLTYFKCVIKETLRLHPPIPVLLHQSSEATEVSGYHIPKGTRVMVNAYAINRDKNSWEDP
DTFNPSRFLQNGAPDFRGSNYEFLPFGSGRRSCPGMQLGLYAMEMAVAHLLHCFTWEL
PDGMKPSEIDMGDVFGLTAPKAIRLVAVPTPRLLCPLY SEQ ID No: 2
>Lettuce_LsF5H_2_1
MDPKSILLYVVLPLLTFFLLSRLRRKPLPPGPRGWPLIGNMLMMDQLTHRGL
ARLGEKYGGLLHLKMGFSHTVAVSSPEIARQVLQVQDNIFANRPATIAISYLTYDRQDM
AFANYGPFWRQMRKLCVMKLFSRKRAESWDSVRDEVVSMVKITAASSGTAVNLGELV
FGLTHDIIYRAAFGSISHEGKEEFIRILQEYTKLFGAFNLADFVPWLGFIDPAGLNTRLPKA
RAALDRFIDKIIDEHLAKERKTGDEEDNDMVDEMLAFYSEEGKVNEGEDLQNAIRLTRN
NIKAIIMDVMFGGTETVASAIEWALTELMHTPESLKRAQQELADVVGLDRRVEESDFEK
LTYFKCVIKETLRLHPPIPVLLHQSSEATSVAGYHIPKGTRVMVNAFAINRDKNSWKDPH
TFNPSRFLQDGAPDFKGSNYEFLPFGSGRRSCPGMQLGLYAMEMAVAHLLHSFTWQLP
DGMKPSEIDMNDVFGLTAPKAIRLVAVPTPRLLCPLY SEQ ID No: 3
>Endive_ce_gene1
MDYLQIPIPIYAIIAILTFFFLAWLRRKPLPPGPMGWPIIGNMLMMDQLTHRGL
ASLANKYGGILHLKMGFSHTIAVSSPEIARQILQEKDNIFANRPATIAITYLTYNRVDMAF
ANYGPFWRQMRKLCVMKLFSRKRAESWDSVRDEVDTMVKATATNSGLPVNLGELVF
GLTHDIIYRAAFGSISHEGKEEFIRILQEYTKLFGAFNLADFIPMLGFIDPAGLNTRLPAAR
AALDGFIDKIIDEHLSKEKKTGDENVDNDMVDEMLAFYSEDGRINEGGDLQNAINLTRD
NIKAIIMDVMFGGTETVASAIEWTMTELMHTPEALXRVQQELTNVVGLDRRVEESDFEK
LTYFKCVIKETLRMHPPIPVLLHQSSEATEVSGYHIPKGTRVMVNAYAINRDKXSWEDP
DTFNPSRFLQNGAPDFRGSNYEFLPFGSGRRSCPGMQLGLYAMEMAVAHLLHCFTWDL
PDGMKPSEIDMGDVFGLTAPKAIRLVAVPTPRLLCPLY SEQ ID No: 4
>Endive_ce_gene2
MDSLQIPIPVYAIIAILTFFFLAWLRRKPLPPGPIGWPIIGNMLMMDQLTHRGL
ASLAKKYGGILHLKMGFSHTIAVSSPEIARQILQEKDNIFANRPATIAITYLTYNRVDMAF
ANYGPFWRQMRKLCVMKLFSRKRAESWDSVRDEVDTMVKATAINSGLPVNLGELVFG
LTHDIIYRAAFGSISHEGKEEFIRILQEYTKLFGAFNLADFIPMLGFIDPAGLNTRLPAARA
ALDGFIDKIIDEHLSKEKKTGDENVDNDMVDEMLAFYSEDGRVNEGGDLQNAINLTRD

| SEQUENCES |
|---|
| NIKAIIMDVMFGGTETVASAIEWTMTELMHTPEALKRVQQELTNVVGLDRRVEESDFEK<br>LTYFKCVIKETLRMHPPIPVLLHQSSEATEVSGYHIPKGTRVMVNAYAINRDKNSWEDP<br>DTFNPSRFLQNGAPDFRGSNYEFLPFGSRRSCPGMQLGLYAMEMAVAHLLLCFTWEL<br>PDGMKPSEIDMGDVFGLTAPKAIRLVAVPTPRLLCPLY<br><br>SEQ ID No: 5<br>>Endive_ce_kethel_v0.1_EVM71979<br>MDPMSILLYVVLPLFTFFLLSRFRRKPLPPGPRGWPVIGNMLMMDQLTHRGL<br>ARLGEKYGGLLHLKMGFSHTVAVSSPEIARQVLQVQDNIFANRPATIAISYLTYDRQDM<br>AFANYGPFWRQMRKLCVMKLFSRKRAESWDSVRDEVVSMIKITAASSGSAVNLGELVF<br>GLTHDIIYRAAFGSISHEGKEEFIRILQEYTKLFGAFNLADFIPWLGFIDPAGLNNRLPKAR<br>AALDGFIDKIIDEHLRKEKKTGDEEDNDMVDEMLAFYSEEGKVNEGEDLQNAIRLTRNN<br>IKAIIMDVMFGGTETVASAIEWALTELMHTPESLKRAQQELVDVVGLDRRVEESDFEKL<br>TYFRCVIKETLRLHPPIPVLLHQSSEATEVAGYHIPKGTRVMVNAFAINRDKNSWKDPHT<br>FNPSRFLQDGAPDFKGSNYEFLPFGSRRSCPGMQLGLYAMEMAVAHLLHSFTWQLPD<br>GMKPSEIDMSDVFGLTAPKAIRLVAVPTPRLLCPLY<br><br>SEQ ID No: 6<br>>Chicory_ci_vitessa_fr_vl_EVM170737<br>MDSLQIPIPVYAIIAVLTFVFVAWLRRKPLPPGPMGWPIIGNMLMMDQLTHR<br>GLASLAKKYGGILHLKMGFSHTIAVSSPEIARQILQEKDNIFANRPATIAITYLTYNRVDM<br>AFANYGPFWRQMRKLCVMKLFSRKRAESWDSVRDEVDTMVKATATNSGLPVNLGEL<br>VFGLTHDIIYRAAFGSISHEGKEEFIRILQEYTKLFGAFNLADFIPMLGFIDPAGLNTRLPA<br>ARAALDGFIDKIIDEHLSKEKKTGDENVDNDMVDEMLAFYSEDGRINEGGDLQNAINLT<br>RDNIKAIIMDVMFGGTETVASAIEWTMTELMHTPEALKRVQQELTNVVGLDRRVEESDF<br>EKLTYFKCVIKETLRMHPPIPVLLHQSSEATEVSGYHIPKGTRVMVNAYAINRDKNSWE<br>DPDTFNPSRFLQNGAPDFRGSNYEFLPFGSRRSCPGMQLGLYAMEMAVAHLLHCFTW<br>ELPDGMKPSEIDMGDVFGLTAPKAIRLVAVPTPRLLCPLY<br><br>SEQ ID No: 7<br>>Chicory_ci_vitessa_fr_v1_EVM170780<br>MDSLQIPIPVYAIIAILTFFFLAWLRRKPLPPGPMGWPIIGNMLMMDQLTHRGL<br>ASLAKKYGGILHLKMGFSHTIAVSSPEIARQILQEKDNIFANRPATIAITYLTYNRVDMAF<br>ANYGPFWRQMRKLCVMKLFSRKRAESWDSVRDEVDTMVKATAINSGLPVNLGELVFG<br>LTHDIIYRAAFGSISHEGKEEFIRILQEYTKLFGAFNLADFIPMLGFIDPAGLNTRLPAARA<br>ALDGFIDKIIDEHLSKEKKTGDENVDNDMVDEMLAFYSEDGRVNEGGDLQNAINLTRKT<br>NIKAIIMDVMFGGTETVASAIEWTMTELMHTPEALKRVQQELTNVVGLDRRVEESDFEK<br>LTYFKCVIKETLRMHPPIPVLLHQSSEATEVSGYHIPKGTRVMVNAYAINRDKNSWEDP<br>DTFNPSRFLQNGAPDFRGSNYEFLPFGSRRSCPGMQLGLYAMEMAVAHLLHCFTWEL<br>PDGMKPSEIDMGDVFGLTAPKAIRLVAVPTPRLLCPLY<br><br>SEQ ID No: 8<br>>Chicory_ci_vitessa_fr_v1_EVM158591<br>MDPMSILLYVVLPLFTFFLLSRLRRKPLPPGPRGWPVIGNMLMMDQLTHRGL<br>ARLGEKYGGLLHLKMGFSHTVAVSSPEIARQVLQVQDNIFANRPATIAISYLTYDRQDM<br>AFANYGPFWRQMRKLCVMKLFSRKRAESWDSVRDEVISMIKITAASSGSAVNLGELVF<br>GLTHDIIYRAAFGSISHEGKEEFIRILQEYTKLFGAFNLADFIPWLGFIDPAGLNTRLPKAR<br>AALDGFIDKIIDEHLSKEKKTGDEEDNDMVDEMLAFYSEEGKVNEGEDLQNAIRLTRNN<br>IKAIIMDVMFGGTETVASAIEWALTELMHTPESLKRAQQELADVVGLDRRVEESDFEKL<br>TYFRCVIKETLRLHPPIPVLLHQSSEATEVAGYHIPKGTRVMVNAFAINRDKNSWKDPH<br>MFNPSRFLQDGAPDFKGSNYEFLPFGSRRSCPGMQLGLYAMEMAVAHLLHSFTWQLP<br>DGMKPSEIDMSDVFGLTAPKAIRLVAVPTPRLLCPLY<br><br>SEQ ID No: 11<br>>Celery_RZ_draft_99.605_EVM363634<br>MSLLFILLLTIISMIFFISRFGGKPYPPGPRRLPVIGNTLMMACLTHRGLAKLAS<br>RYGGLFYLRMGAQDIVVVSTPDMARQILQTHQDQISNRPTSIALDYLSYGRANMAFAD<br>YSPWWRQMRKICVMKLFSRARVESWNSVRDELNHMLRDVASNANQAINLGELVFGFT<br>EKIIYRAAFGSRLSDGGTEFIKIMQEFSKLFGSFNVCDFVPWMSRADPQGLKARLRKARG<br>SLDTFIDSIIDQHIIKRKGKNIGDKDMVDELLAFYTEEGEAKAESDDLQATIKLTKNNIKGI<br>IMDIMFGGTETVAAAIEWAMSELLKNPEELRKTQEELSNVVGLHRCVEEGDLEKLTYLK<br>CVLKETLRLHPPLPFLPRAAAEDVYVAGYYIPAGSRVIINLWANIGHDGKCWNDEPEAF<br>KPSRFLDVGAPDYRNNNFEFIPFGTGRRSCPGMQLGLHAFEMGLAHLLHCFNWELPDG<br>MKPSQVDMSDMYGLSAPKATRLIAVPTPRLLCPIC<br><br>SEQ ID No: 12<br>>Celery_RZ_draft_99.605_EVM348724<br>MTTIFFFLLLLCLFLARRKPYPPGPKGWPIIGNMLIMDKLTHRGLAKIATQYG<br>GIVHLRMGFLHMVTVSTPDMVREVLQIQDTVFANRPATMNISYLTYNRADMAFANYGP<br>FWRQMRKISIIKLFSRKRAESWDSVRDQVDDMLGKVVSNSGLSVNIGELVFGLTRNIIYR<br>AAFGSISGQGQDEFIKIMQEFSKLFGAFNICDFVPGITWLDPQGFKVRLVKARESLDKFID<br>SILDEHIANQKSNLNGSTDEGNGDMVYQLLAFYSEEQSKVNHSDDTNNALKLTRDNIKA<br>IIMDVMFGGTETVASAIEWAMSELMGSPEDLKRVQQELIDVVGLHRRVEENDFDKLIYL<br>KCCIKETLRLHPPIPLLLHETAQEAVVAGYHIPAKSRVMINSWAVNRDPNSWDDPEKFK<br>PSRFLKQGMPDFKGSNFEFIPFGSRRSCPGMQLGLYAFEMAVAHLLHSFNWELPDGM<br>KPSELDTNDVFGLTAPRATRLVAVPTPRLLCSIC |

| SEQUENCES |
|---|

SEQ ID No: 13
>Celery_c17480_g1_i1|m.26831
METNTTAMTILFFILPLLSFFLLSSFRRKRYPPGPKGWPIIGNLLMMDKLSHRG
LAKLAAQYGGLVHLRMGFLHMFTVSTPDMAREVLQIQDNIFANRPATMNISYLTYDRA
DMAFANYGPFWRQMRKISVMKLFSRKRAESWDSVREEVDDMVKIVLSKTGCSVNIGEL
VFGLTRNIIYRAAFGTLSHEGQDEFIKILQEFSKLFGAFNICDFVPGLTWADPQGFMGRV
VKARASLDGFIDSIIDAHIEKKKSSKNGIIDEGNSDMVYELLDFYGEEKAKVSEFEDQNSS
LKLTRDNIKAIIMDVMFGGTETVASAIEWAMSELMRSPKDLKKVQQELVNVVGLHRRV
EESDFDKLTYLKCCIKETLRLHPPIPLLLHETAQDAEVAGYHIPARSRVIINSWAINRDPNS
WTDPDTFKPSRFLQEGMPDFKGSNFEFIPFGSGRRSCPGMQLGLYALEIAVAHLLHCFN
WELPDGMKPSEVDTDDVFGLTAPRATRLVAVPTPRLLCPIS SEQ ID No: 14
>Brassica_Bo1g005770
MESSISQTLSQVLDPTTGILIVVSLFIFIGLITRGRRPPYPPGPRGWPIIGNMSMM
DQLTHRGLANLAKKYGGLCHLRMGFLHMYAVSSPDVARQVLQVQDSVFSNRPATIAIS
YLTYDRADMAFAHYGPFWRQMRKVCVMKVFSRKRAESWASVRDEVDRMIRSVSSNV
GKSINVGEQIFALTRNITYRAAFGSACEKGQDEFIRILQEFSKLFGAFNVADFIPYFGWIDP
QGINKRLVKARNDLDGFIDDIIDEHIKKKENQNSIDAGDVVDTDMVDDLLAFYSEEAKL
VSETADLQNSIKLTRDNIKAIIIVIDVMFGGTETVASAIEWALTELLRSPEDLKRVQQELAE
VVGLDRRVEESDIEKLTFLKCTLKETLRLHPPIPLLLHETAEDTEIDGYFVPKKSRVMINA
FAIGRDKNSWVDPETFRPSRFLEPGVPDFKGSNFEFIPFGSGRRSCPGMQLGLYALELAV
AHILHCFTWKLPDGMKPSELDMSDVFGLTAPKATRLYAVPSTRLICSV SEQ ID No: 15
>Brassica_Bo7g117840
MESSVSQTLSQVLDPTTAILIVVSLFIFIGLITRRRSYPPGPRGWPIIGNMLMM
DQLTHRGLANLAKKYGGLCHLRMGFLHMYAVSSPDVARQVLQVQDSIFSNRPATIAIS
YLTYDRADMAFAHYGPFWRQMRKVCVMKVFSRKRAESWASVRDEVDKMIRSVSSNV
GKSINVGEQIFALTRNITYRAAFGSACEKGQDEFIRILQEFSKLFGAFNVADFIPYGWIDP
QGINKRLVKARNDLDGFIDDIIDEHMKKKENQNTVDDGYVGDTDMVDDLLAFYSEEAK
LVSETTDLQNSIKLTRDNIKAIIMDVMFGGTETVASAIEWALTELLRSPEDLKRVQQELA
EVVGLDRRVEESDIEKLTFLKCTLKETLRLHPPIPLLLHETAEDTEIDGYFVPKRSRVMIN
AFAIGRDPKSWPDAETFRPSRFLEPGVADFKGSNFEFIPFGSGRRSCPGMQLGLYALELA
VAHILHCFTWKLPDGMKPSELDMNDVFGLTAPKATRLFAVPSTRLICAV SEQ ID No: 16
>Brassica_Bo7g119430
MDCLLCSPILYVVLIFLWYLVRVLLTRSNPFPPGPKGYPIIGNMKLKNQLNHR
GLAELAKQYGGLLHLQMGRIHIVAASTAEMAREILQVQDVVFANRPANVAISYLTYNR
ADMAFANYGPLWRQMRKVCVMKLFSRKRAESWASVRDEINTMVQTLTKQTGSPVNV
GELVFALTRNITYRAAFGSFARDGQDEFVKILQEFSKLFGAFDITEFLPWMKWFSNRDFS
KRLENARKSLDGFIDRIIDAHIEKKNSRKQDDDGLEDDMVDELMAFYSGESGENGGKSN
DSLSSFKLTRDNIKALVMDVMFGGTETVASAIEWAMTELMKNPHELVKLQQELADVIG
LNREFHESDLENLPYFRCAMKETLRLHPPIPLLLHEAAADSVVSGYSIPRDSRVMINVYAI
GRDGSVWTEPDAFRPGRFMDSKAPDFKGSDFEFLPFGSGRRSCPGMQLGLYAMELAVA
HMLHSFDWELPEGGSSDDLDMTDMFGLTAPRATRLIAVPSYRLKCPMVI SEQ ID No: 17
>Brassica_Bo3g093960
MESLLSQTLNQVIDPTPSVLLITISLLVVVYLISQWFKPLYPPGPKGLPVIGNM
LMMDQLTHHGLAKLAHKYGGLFHLRMGFRHVFAITSPDVARQVLQVQDISFSNRPVNV
AINYLTYDLADMAFAPYGPFWREMRKVCVMKVFSRKRTESWASVREEVNNMVRSFSS
NVGKPVNVGELIFTLTRNITYRAAFGAACETEQDEFIRILQEFSKLFGAFNIADFIPFLGWF
DFPQGINKRLVKARNDLDGFIDEVIDEHMKKRETVNVDEDTDMVDDLLAFYSEDSSTNR
NKNTVKLTRDNIKALVMDVMFGGTETMASGIEWALTELLRNPAELKRLQQELTEVVGL
DRRVDDTHLEQLTFLKCTLKETMRLHPPIPLILHEAIEDRKLQGFFVPKGSRLMINAFAIA
RDPKLWVDPEAFRPSRFMEPGMPDFMGTNFEFIPFGAGRRSCPGMQLGLYAMEVAVAN
IIHCFTWKLPDGMKPSELDMSDVMGLTAPRATRLIAVPDTRLICPVYP SEQ ID No: 18
>Brassica_XP_013607401.1
MYTLMTLILLVPLLLFLFRHLLSRRLRQRKPYPPGPKGLPIIGNILMMNQFNHR
GLAKLSRTYGGLLHLRLGISHLFVVSSPQIARQVLQVQDHVFSNRPTTIAIRYLTYGQSD
LAFCNYGPFWRRMRKLYVMMLFSRKRAESWASVDEEVHKAVRSVAANVGKPLNVCK
VAFSLTRDITFRAAFGSSSSSSNEGRLDEFLEIIQEFSKLFGEFNVADYVPSWLSWIDPQGI
NKRVEKARKSLDCFIESIINDHLDKKKTEKNVNVDEVTDMVDQLLAFYKEEVKVKDSE
TKINLDNIKGIIMDVMFGGTETVALAIEWVLTELLRSPENMKRVQDELATVVGLERWSV
EDTHLEKLSFLKCVLKDTLRLHPPFPLLLHETVEEAEVSGYFIPKGSRVMVXTYALGRDP
ASWSDPEIFNPSRFLDPGAPDLKGNSFEFIPFGSGRRSCPGMQLGMYAFELAVAHLLHCF
TWRLPDGVKFGDVDTIEGPGLTVAKANSLVAVPIKRLLCPMVLESHNV SEQ ID No: 19
>Eggplant_c18725_g1_i1|m.19489
MKEMVQKNINSILEALQANPMLLFLFIIPLFFLYLFSTSSRRRYPPGPRGWPLIG
NMMIMDQLTHRGLAKLAEKYGGVMHLKMGYIHKIVISGPEEARQVLQVQDNIYSNRPA
TVAISYLTYDRADMAFADYGPFWRQMRKLCVMKLFSRKRAESWDSVRDEVDSLIKIVT

| SEQUENCES |
|---|
| TNAGTSVNLGELVFGLTRDIIYRAAFGTSSAEGQEEFIKILQEFSKLFGAFNMVDFIPWLG<br>WIGQQGLNVRLANARASLDGFIDSIIDDHIERKKANVTIDNGDRETDMVDELLAFYSEEA<br>TVNESEDNLQNAIRLTRDNIKAIIMDVMFGGTETVASAIEWMAELVKNPEELKKVQQE<br>LANVVGLNRRVEESDLEKLTYLKCCLKETLRLHPPIPLLLHETAEESTIFGYHIPAGSHVV<br>INSFAIGRDKNSWEDADSYKPSRFLKQGVPDFKGGNFEFLPFGSGRRSCPGMQLGLYAL<br>EMAVAHLLHCFTWELPDGMKPSELKMDDTFGLTAPLANRLVVVPSPRLLCTLY<br><br>SEQ ID No: 20<br>>Eggplant_sm_67_3_v1_EVM1128231_<br>MKEIIQNNTFFILTTKETNLMMPLYFIFPIFIFFFFTISRLNKKNFPPGPKGWPIIG<br>NMMMMDQLTHHGLAKLAKKYGGILHLQMGYLQMTVVSSPAEAREVLQLQDTIFANRP<br>TTIAVEYLSYARADMAFANYGPFWRQMRKLCVMKLFSRKRAESWDSIRDEVESMTMA<br>VATRVGSSVNIGELVFGVAKNIIYRAAFGTCSNRGQDELLNIMQEFSKLFGAFNLADFIP<br>WLGWVDPQGLNKMIIKARASLDGFIDTIIDDHIQRKKTNNYNDEGNNNDMVDELLAFY<br>GEKTKLNDSDDLTNALRLTRDNIKSIIMDIMFGATETVASAIEWAMAELMKSPEDLKMV<br>QQELANVVGLHRKVEEMDFEKLIFLKCCIKETLRLRPPIPLLVHESVEDTTINNYYIPAKS<br>RVIVNAWAIGRDKNSWDDPESFKPSRFLKEGVADFKGGDFEFLPFGSGRRSCPGMQMG<br>LYAFEMTLAHLLHCFNWELPNGMKPSDIDMNDVFGLTVPKATRLVAVPTRLLCQLY<br><br>SEQ ID No: 21<br>>Potato_XP_006340697.1<br>MKEMVLNNINSTLEALQAQPMLLFFFIIPLFFLYLFSTSRRKRYPPGPLGWPLI<br>GNMMMMDQLTHRGLAKLAQKYGGVFHLKMGYVHKIVISGPEEARQVLQVQDNIYSN<br>RPKTVAISYLTYDRADMAFADYGPFWRQMRKLCVMKLFSRKRAESWDSVRDEVDSM<br>VKIVTTNTGTSINLGELVFCLTRNIIYRAAFGTSSDEGQDDFIKILQEFSKLFGAFNMADFI<br>PWLRWIGQQGLNVRLAKARASLDGFIDSIIDDHIERKKANVINDDGYRESDMVDELLAF<br>YSEETKVNESEDLQNSIRLTRDNIKAIIMDVMFGGTETVASAIEWAMAELMKSPEDLKK<br>VQQELANVVGLNRKVDESDFEKLTYLKCCLKETLRLHPPIPLLLHETAEESTVSGYYIPA<br>KSHVIINSFAIGRDKNSWEDPDSFKPSRFLKEGVPDFKGGNFEFLPFGSGRRSCPGMQLG<br>LYALEMAVAHLLHCFTWELPDGMKPSELKMDDIFGLTAPLANRLVAVPTRLLCNY<br><br>SEQ ID No: 22<br>>Apple_XP_008372753.1<br>MDYLLQSLQPLQSMTPLLLIIPLLFLLPLIFRFRRPPPYPPGPKGLPLIGNMLLM<br>DQLTHRGLAKLAKKYGGIFHLRMGFLHMVAISNPDVARQVLQVQDNIFSNRPATIAISY<br>LTYDRADMAFAHYGPFWRQMRKLCVMKLFSRKRAESWESVRDEVDSSVRTVTVHVG<br>SAVNIGELVFSLTKNIIYRAAFGTSSQEGQDEFIGILQEFSKLFGAFNIADFIPSLGWVDPQ<br>GLNNRLAKARESLDRFIDTIIDDHMEKKRNGKGVSDGETDMVDELLAFYSEEAKVYESE<br>DNLQNAIKLTRDNIKAIIMDVMFGGTXTVASAIEWAMSELMKSPEDLKRVQQELADVV<br>GLDRRPEETDFEKLTYLKCALKETLRLHPPIPLLLHETSEDAVVAGYRIPKRSRVMINAW<br>AIGRDKDSWEDAESFKPSRFLKEGVPDFKGSNFEFIPFGSGRRSCPGMQLGLYALEMAV<br>AHLLHCFTWELPDGMKPSELDMNDVFGLTAPRASRLIAVPSKRVVCPL<br><br>SEQ ID No: 23<br>>Apple_XP_008337913.1<br>MDSLLQSLQPLKSMTPLVFIIPLLFLLPLIFCFRRRPPYPPGPKGLPLFGNMLM<br>MDQLTHRGLAKLAKQYGGIFHLRMGFLHMVAISNPDVARQVLQVQDNIFSNRPATIAIS<br>YLTYDRADMAFAHYGPFWRQMRKLCVMKIFSRKRAESWESVRDEVDTAVRTVTVHV<br>GSAVNIGELVFSLTKNIIYRAAFGTSSQEGQDEFIGILQEFSKLFGAFNIADFIPSLGWVDP<br>QGLNNRLAKARESLDRFIDTIIDDHMEKKKNNKGLNDGETDMVDDLLAFYSEEAKVN<br>ESEDNLQNAIKLTRDNIKAIIMDVMFGGTETVASAIEWAMSELMKNPEDLKRVQQELLN<br>VVGLDRRPEEADFEKLTYLKCALKETLRLHPPIPLLLHETSEDAVVAGYHIPKKSRVMIN<br>AWAIGRDKDSWEDPESFKPSRFLKEGVPDFKGSNFEFIPFGSGRRSCPGMQLGLYALEM<br>AVAHMLHCFTWELPDGMKPSELDMNDVFGLTAPRASRLVAVPSKRVVCPL<br><br>SEQ ID No: 24<br>>Apple_XP_008391587.1<br>MELLHQALQSLQSSPMLLILLLLLLIISFIFLFNSRRKPPYPPGPKGWPIIGNML<br>MTDQLTHRGLAHLAKQYGGLLHLQMGVIHVMAVSTPDMAREILQSQDSLFANRPANV<br>AISYLTYDRADMAFANYGPFWRRMRKICVINLFSRKRAESWASVREEVDEMVQTVAG<br>KTGSPVNIGQLVFALTRNITYRAAFGSSSHEGQGEFVQILQEFSKLFGAFNMQDFLPWLG<br>WVHAQGFQDRMARARKSLDVFIDKIIDDHMAKRKANMEKDDSEAADTDMVDELIAYF<br>SDDAGKEGDDPNSGFKLTRDNIKALIMDVMFGGTETVASVIEWTMAELMKSPEDLKRV<br>QQELTDVVGLNRRLQETDLENLTYLKCAVKESLRLHPPIPLLTHETVEDTSVAGYSFPAG<br>SRVWINAWAIARDPTAWDEPETFKPSRFLEDSSPDFKGSNFEFIPFGSGRRSCPGMALGL<br>YGLEMAVAHLLHCFAWELPGGMKPSELDMNDVFGLTAPKAVQLVAVPTYRLNCPL<br><br>SEQ ID No: 25<br>>Pear_XP_009378215.1<br>MDSLLQSLQALQSMTPLLLIIPLLFLLPLIFRFRRPPPYPPGPKGLPLIGNMLLM<br>DQLTHRGLAKLAKKYGGIFHLRMGFLHMVAISNPDVARQVLQVQDNIFSNRPATIAISY<br>LTYDRADMAFAHYGPFWRQMRKLCVMKLFSRKRAESWESVRDEVDSAVRTVTVHVG<br>SAVNIGELVFSLTKNIIYRAAFGTSSQEGQDEFIGILQEFSKLFGAFNIADFIPSLGWVDPQ<br>GLNNRLAKARESLDRFIDTIIDDHMEKKRNGKGVSDSETDMVDELLAFYSEEAKVNESE<br>DNLQSAIKLTRDNIKAIIMDVMFGGTETVASAIEWAMSELMKSPEDLKRVQQELADVVG |

| SEQUENCES |
|---|
| LDRRPEETDFEKLTYLKCALKETLRLHPPIPLLLHETSEDAVVAGYRIPKRSRVMINAWA<br>IGRDKDSWEDAESFKPSRFLKEGVPDFKGSNFEFIPFGSGRRSCPGMQLGLYALEMAVA<br>HLLHCFTWELPDGMKPSELDMNDVFGLTAPRASRLIAVPSKRVVCPL<br><br>SEQ ID No: 26<br>>Pear_XP_009338655.1<br>MDSLLQSLQPLQSMTPLLLIIPLLFLLPLIFRFRRPPPYPPGPKGLPLIGNMLLM<br>DQLTHRGLAKLAKKYGGIFHLRMGFLHMVAISSPDVARQVLQVQDNIFSNRPATIAISY<br>LTYDRADMAFAHYGPFWRQMRKLCVMKLFSRKRAESWESVRDEVDSAVRTVTVHVG<br>SAVNIGELVFSLTKNIIYRAAFGTSSQEGQDEFIGILQEFSKLFGAFNIADFIPSLGWVDPQ<br>GLNNRLAKARESLDRFIDTIIDDHMEKNRNGKGVSDSETDMVDELLAFYSEEAKVNESE<br>DNLQSAIKLTRDNIKAIIMDVMFGGTETVASMEWAMSELMKSPEDLKRVQQELADVVG<br>LDRRPEETDFEKLTYLKCALKETLRLHPPIPLLLHETSEDAVVAGYRIPKRSRVMINAWA<br>IGRDKDSWEDAESFKPSRFLKEGVPDFKGSNFEFIPFGSGRRSCPGMQLGLYALEMAVA<br>HLLHCFTWELPDGMKPSELDMNDVFGLTAPRASRLIAVPSKRVVCPL<br><br>SEQ ID No: 27<br>>Pear_AGR44939.1<br>MDSLLQSLQPLKSMTPLVFIIPLLFLLPLIFRFRRLPPYPPGPKGLPLIGNMLMM<br>DQLTHRGLAKLAKQYGGIFHLRMGFLHMVAVSNPDVARQVLQVQDNIFSNRPATIAISY<br>LTYDRADMAFAYYGPFWRQMRKLCVMKLFSRKRAESWESVRDEVDSAVRTVTVHVG<br>SAVNIGELVFSLTKNIIYRAAFGTSSQEGQDEFTAILQEFSKLFGAFNIADFIPSLGWVDPQ<br>GLNNRLAKARESLDRFIDTIIDDHMEKKKNNKGLNDGETDMVDELLAFYSEEAKVNESE<br>DNLQSAIKLTRDNIKAIIMDVMFGGTETVASMEWAMSELMKSPEDLKRVQQELADVVG<br>LDRRPEETDFEKLTYLKCALKETLRLRPPIPLLLHETSEDAVVAGYRIPKRSRVMINAWAI<br>GRDKDSWEDAESFKPSRFLKEGVPDFKGSNFEFIPFGSGRRSCPGMQLGLYALEMAVH<br>LLHCFTWELPDGMKPSELDMNDVFGLTAPRASRLIAVPSKRVVCPL<br><br>SEQ ID No: 28<br>>Pear_XP_009346304.1<br>MDSLLQSLQPFTSMTPLVFIIPLLFLLPLIFRFRRLPPYPPGPKGLPLIGNMLMM<br>DQLTHRGLAKLAKQYGGIFHLRMGFLHMVAVSNPDVARQVLQVQDNIFSNRPATIAISY<br>LTYDRADMAFAHYGPFWRQMRKLCVMKLFSRKRAESWESVRDEVDTAVRTVTVHVG<br>SAVNIGELVFSLTKNIIYRAAFGTSSQEGQDEFTAILQEFSKLFGAFNIADFIPSLGWVDPQ<br>GLNNRLAKARESLDRFIDTIIDDHMEKKKNNNKGLNDGETDMVDDLLAFYSEEAKVNE<br>SEDNLQNAIKLTRDNIKAIIMDVMFGGTETVASAIEWAMSELMKSPEDLKRVQQELFNV<br>VGLDRRPEEADFEKLTYLKCALKETLRLHPPIPLLLHETSEDAVVSGYHIPKQSRVMINA<br>WAIGRDKDSWEDPESFKPSRFLKDGVPDFKGSNFEFIPFGSGRRSCPGMQLGLYALEMA<br>VAHMLHCFTWELPDGMKPSELDMNDVFGLTAPRASRLVAVPSKRVVCPL<br><br>SEQ ID No: 29<br>>Pear_XP_009378429.1<br>MELLRQALQSLQSSPMLLILLLLLVISLIFLFNSRRKLPYPPGPKGWPIIGNML<br>MTDQLTHRGLAHLAKQYGGLLHLQMGAIHVIAVSTPDTAREILQVQDSSFANRPANIAL<br>SYLTYDRADMAFANYGPFWRRMRKICVINLFSRKRAESWASVREEVNEMVQTVAGKT<br>GSPVNIGQLVFALTRNITYRAAFGSRSHEGQGEFVKILQEFSKLFGAFNMQDFLPWLGW<br>VHAQGFQDRMARARKSLDVFIDKIIDDHMAKRKANTENKDDSEAADTDMVDELIAYFS<br>DDAGKEGDDPNSGFKLTRDNIKALIMDVMFGGTETVASVIEWTMAELMKSPEDLKRVQ<br>QELTDVVGLNRRLQETDLENLTYLKCAVKESLRLHPPIPLLLHETVEDTSVAGYSFPAGS<br>RVWINAWAIARDPTAWDEPETFKPSRFLDDGSPDFKGSNFEFIPFGSGRRSCPGMALGLY<br>GLEMAVAHLLHCFAWELPGGMKPSELDMNDVFGLTAPKAVQLVAVPTYRLNCPL<br><br>SEQ ID No: 30<br>>Peach_XP_007199246.1<br>MDDLLLHQALESLQSSPMLFILLFLLIISWFVLFMSRRKLPYPPGPRGWPIIGN<br>MLMMDQLTHRGLAQLAKQYGGLLHLQMGVLHIMVVSSPKVAREILQVQDSSFANRPA<br>NAAISYLTYDRADMAFANYGPFWRRMRKICVINLFSRKRAESWASVREEVEEMVRHVA<br>TKTSSPVNIGQLVFTLTKNITYRAAFGSSSHEGQGEFVKILQEFSKLFGAFNMQDFLPWL<br>GWVHAQAFKDRMAKARRSLDVFIDKIIDDHMAKRNTNKAKKDDNEAETDMVDELIAF<br>FSDDAAKESDDPNSTFRLTRDNIKAIIMDVMFGGTETVASVIEWTMAELMKSPEDLQKV<br>QQELINVVGLNRRVQETDLENLTYLKCAVKESLRLHPPIPLLLHETAEEETSVAGYSFPVG<br>SRVYINAWAIARDPTAWDEPETFKPSRFLKDGSPDFKGSDFEFLPFGSGRRSCPGMQLGL<br>YGLEMAVAHLLHCFAWELPEGMKPNELDMNDVFGLTAPKAVQLVAVPSYRLNCPL<br><br>SEQ ID No: 31<br>>Peach_XP_007203643.1<br>MDSLLQALQPLQPMTLFFIIPFLFLSGLVFLYRSRRRSPYPPGPTGLPIIGNMLM<br>MDQLTHRGLAKLAKQYGGIFHLRMGFLHMVGISNPDVARQVLQVQDNIFSNRPATIAIS<br>YLTYDRADMAFAHYGPFWRQMRKLCVMKLFSRKRAESWDAVRDEVDTAVRTVAVQ<br>AGSAVNIGELVFSLTKNIIYRAAFGTSSEEGQDEFIGILQEFSKLFGAFNIADFIPCLGWVD<br>PQGLNNRLARARQSLDRFIDSIIDDHIQKKKKKKSEGSNGGETDMVDELLAFYSDEAKV<br>NESDDNLQNAINLTRDNIKAIIMDVMFGGTETVASAIEWAMAELMRNPEELKRVQQEL<br>ADVVGLDRRPEEGDFEKLTYLKCALKETLRLHPPIPLLLHETAEDAEVAGYHIPKKSRV<br>MINSWAIGRDKDSWEDAESFKPSRFLKEGVPDFKGSNFEFLPFGSGRRSCPGMQLGLYS<br>LELAVGHLLHCFTWELPDGMKPSELDMNDVFGLTAPRASRLIAVPSKRVVCPL |

SEQUENCES

SEQ ID No: 32
>Banana_XP_009384541.1
MEWSEEVTPLHFMVCFALPLVLLYVVATRRRGKLPFPPGPPQLPVIGNMLM
MDQLTHRGLAKLGEHYGGLCHLRLGFLHAFAVSTPEIARQVLQVQDNVFSNRPATIAIS
YLTYNRADMAFAHYGPFWRQMRKLCVMKLFSKKRAESWASVREEVDVAVRSLADRA
GSAVNVGELLFNLTKNIIFRAAFGTQSHENQNEFISILQEFSKLFGSFNIGDFIPWLSWMD
PQGINKRLKVARASLDRFIDKIIDEHMANRKEADASDADMVDDMLAFLDESGYRCQAG
ERDDLQGTLKLTRNNIKAIIMDVMFGGTETVASAIEWAMAELMKSPEDMKRVQQELAH
VVGLDRKVHESDLDKLSFLKCVTKETLRLHPPIPLLLHETAEDCEVAGYTVPARSRVMI
NVWAIGRDKSSWEDADAFRPSRFTPGGCAASLDFKGNYFEFLPFGSGRRSCPGMQLGL
HALELAVAQLIHCFTWTLPDGMKPSELDMGDVFGLTAPRAVRLAAVPAPRLSCPLY SEQ ID No: 33
>Banana_XP_009384087.1
MEWLEEVTSMRFVVCVVVPVTLLLAASTRWRRKLPFPPGPTPLPIVGNMLM
MGQLTHRGLAKLSERFGGLCHRLRLGFVHVFAVSTSEIARQVLQVQDAVFSNRFATIAIT
YLTYDRADMAFAHYGPFWRQMRKLCVMKLFSKKRAVSWASVREEVDAAVRAVTDG
AGAAVNLGELMFNLTKNITFRAAFGTQSHENQEEFIAILQEFSLLFGAFNIGDFIPWVSW
MDLQGINKRFKVAREALDGFIDKIIEEHMANPKEADAEDSDMVDEMLAFFEESRDRTKE
NEADELQRTLRLTRNNIKAIIMDVMFGGTETVASAIEWAMAELMKNPEDMIRRVQEELA
SVVGLHRKVRESDLDKLPHLKCAVKETLRLHPPIPILLHETAEDCQLTGYAVPARSRIMI
NVWAIGRDKSAWEDAEVFRPSRFAPGGEAAALDFKGGCFEFLPFGSGRRSCPGMQLGL
HALELAVAQLTHCFSWELPDGMKPGELDMGDMFGLTAPRAVRLVAVPTPRLTCPLY SEQ ID No: 34
>Banana_XP_009411495.1
MVWVEEVTSMHLILLCLMLPLTLLLIVNIAARRRRRLPLPPGPTPLPIIGNMLL
MNQLTHRGLARLAKLYGGLLHRLRLGFVHHFVVSTPDVARQVLQVQDSVFSDRPATTAI
VYLTYNRSDLAFAQCGPYWRQMRKLCVTKLFSRKHAESWLSIPEEVDAAVCTVAKHA
GSAFNVRDLAFTLTKNIVFRSAFGKRSDENQEEYIAVVQEIATLLGAFSVGDFIPWLSWM
DPQGINKRLRVARATLDLFIDRIIDEHMATDAANADMVGVMLAFLEESSHEIHRQEEGD
DLKGTLRLSRANIRAVMMDVMFGGTETVAIAIEWALADLLTSPDDLKRVQEELAMVVG
LDRKVHESHLDKLSFLKCAIKETLRLHPPFPLLLHQTADHCEVAGYSIPARSPVMINVWA
IGRDESAWKDADAYRPSRFAPGGDAAALDFKGNCFEFLPFGSGRRSCPGMQLGMHELE
LAVAQLLHCFTWALPDGMKPTELDMGDVFGLSAPKAVPLVAVPTPRLSCPLN SEQ ID No: 35
>Banana_XP_009403617.1
MDWFHQLSFMVASVFIPLALLSFFCMRSGRKLLLPPGPQPLPIIGNMLMMDQ
LTHRGLARLAERYGGLFHLRLGSLHAVVVSTPEMARLVLQVQDASFCNRPVTAAIAYL
TYDRADMAFANYGPFWRQTRKLCVMKLFSRRRLQSWASVRQEVDSAVRFAARRSGSS
VDVGDLAFTLAKNVTFMAAFGAQSHGNQGEFAGILQEYSKLFGEFNISDFLPWLRWMD
LQGIDKRLKVARQAIDRYIDVIIDDHLANPKEADAQDADMVDGMLAFLGDSGDTNEGG
DLHGDLSLTRSNIKAIIMDVMFGGTETVALGIEWAMAELLKSPEELKRTQQELASVVGL
HRKVDDSDLDKLPYLKCAVKEMLRLHPPLPLLQHQATQDCELAGYFIPVGTRVFVNAW
GIGRDRDAWKSPNAFRPSRFALGGDAAAFDFRGSCFELLPFGSGRRSCPGMQLGLYVLE
LAVAQLLHCFDWSLPAGTKPGDLDMGDVFGLTAPKAVRLMAVPTPRLTCPLL SEQ ID No: 36
>Wheat_A0A077RPS5
MATFAKIAMELLADPLMWLFLASLALVAMQRRRLGSAPFPPGPKPLPVIGNM
TLVDQLTHRGLAALAKQFGGLLHLRFGWLHVLAVSTPEYAREVLHAQDGVFSNRPATI
AVVYLTYGRDMAFAHNGAYWRQMRKLCVTKIFSRRRAETWLAVREGYGALAREVGR
RSGEAVNLGELIFNLTVSVIFRAAFSTCDEDGLIEFTAILQEFSRLLGLFHIGDFFPWLAWV
GRRGFNRRLSTARGALDRFIDKIVDEHMRRGKDPADPDADLVDGLLGFLADANPREDA
LRFTRDNVKAMIMDMLFGGPETVGSTTEWAMAEMMRSPDELERLQQELADVVGLDRA
VEESDLDKLPFLRCVVKEALRMHPPIPVLLHEAAKDCVVGGYSIPRGSRVLVIAWAINR
DCGAWKDGDTFRPARFIPGEGEAAGLDLKGSCYEFLPFGSGRRSCPAQGLGQHAVEFA
VAQLAHGFNWKLPDGMKPAELDMGDIFGLTASRSTRLYAVPTPRLTCPV SEQ ID No: 37
>Wheat_W5A2I1
MAAYAKVGTEFLKDPLIWLFLASLAFVILQRRRLGSAPFPPGPKPLPVIGNMA
LVDQLTHRGLAALAKQYGGLLHLRLGRLHVYAVSTPEYAREVLHVQDAALSNRPATIA
VVYLTYGRSDMAFAHNGAYWRQMRKLCVTKIFSRRRAETWLAVREGYGALACAVSR
RCGEAVNLGELIFNLTVSVIFRAAFSTRDEDGLDEFIAILQEFSSLLGLFHIGDFFPWLGW
VGRRGFNRRLRTARGALDKFIDRIIDEHMKRGKNAADPEADLVDGLLAFLAEANPISGK
HREDALRFTRDNAKAMIMDMLFGGPETVGSMTEWAMAEMMRSPDDLRRLQRELANV
VGLHRTVDETDLDKLPFLRCVVKEALRMHPPIPLLLHEAAKDCFVGGYSVPKGSRVLV
NAWAINRDPGAWKDGDTFRPSRFMPGEGEAAELDLNGGCYEFLPFGSGRRSCPAQGLG
QHAVEFAVAQLAHGFNWELPDGMKPAELDMGDIFGLTALRATRLYAVPTPRLTCPM SEQ ID No: 38
>Wheat_W5B6W3
MVGLAKIAMDWLQEPLSWLFVASFVFVVLQRHRQRLRGKAPPLPPGPSPLPI
VGNMFMMDQLTHRGLAALARQYGGILHLRLGQVHAVVLSTPEYAQEVLQAQDVAFSN

SEQUENCES

RPATVAAIYLTYDRADMAFAHYGPFWRQMRKLCVMKLFSRRRAGTWLAVRDESAAL
VRAVARRSGESVNLGELIFNLTKNVTFRAAFGADAAGDAGKRDEFIAIMQEFSQLFGGS
SIGDFIPWLGWVDQGLNVRARTARAALDEFIDKIIDEHMRRGKNPDDVDADMVDDMLA
FLPEAKPKKDAGDDLQNSLHLTRDNIKAMIMDVMFGGTETVASGIEWAMTEMMHSPD
DLRRLQQELADVVGLDRNVDESDLDKLPFLKCVIKETLRLHPPIPILHHENAEDCVVGG
YSVPRGSSVMINVFAIGRDAKVWKDADTFRPSRFMTGEGEAARVDFKGSCFEFLPFGSG
RRSCPGMALGIYSLEFAVAQLAHGFSWALPDGMKPSELDMTDIFGLTAPRATRLCAVPT
PRLTYPLISDVDATHKGNT

SEQ ID No: 39
>Wheat_A0A077RQ37
MVGLTKIAMEWLQDPLSWLFVASVVFVMLQRRRRGRAPPLPPGPNPLPIVG
NMSMMDQLTHRGLTALAKKYGGFLHLRLGKVHAFAVSTPEYAQEVLQVQDAAFSNRP
ASLAATYLTYDRADMAFAHHGPFWRQMRKLCVMKLFSRRRPETWLAVRNESAALVR
AVARRSGETVNLGELIFNLAKNVTFRAAFGAGAAGDAGKQEEFTAILQEFSKLFVEFCIG
DFIPWLSWADPQGINVRLRAARAALDQFIDKIIDEHMKRGRNPDDVDADMVDDMLAFL
PEARTKKAAGDRGDDLQNTLRLTRDNIKAMIMDVMFGGTETVASAIEWAMSEMMHCP
DDLRRLQQELADTVGLDQNVDESDLDKLPFLKCVIKETLRLHPPIPLLNHENAEDCVVG
GYSVPRGSRVMINVFAIGRDASTWKDADAFRPSRFMEGEGEAAGVDFKGGCFEFLPFGS
GRRSCPGMALGLYSLELIVAQLAHGFNLALPDGMAPSELDMRDVFGLTVPRATRLCVV
PTPRLTCSLVADDDAAHQA SEQ ID No: 40
>Wheat_W5AC21
MVDLSMIDMEWLQEPLSWLFVASVIFVLLQRRRGKAPPLPPGPYSPPIVGNIF
MMDQLTHRGFAALAKQYGGLLHLRLGKVHTFAVSTPEYAQQVLQAQDAAFSHRPATI
ATTYLTYDRADMVFARYGPFWRQMRKLCVMKLFSRRRPGTWLAVRDESAALVRAVA
RRSGEPVNLGDLIFNLSMNVTFRAAFGAEAAGDGDGRKQHEFIAIMQEFSKLFGAFSIGD
FIPWLGWADPQGIKVRLRAARTALDEFIDKIIDEHIKRGRNPDDMDADMVDGMLAFLPE
AKPDKAAGDDLHHTLRLNRDNIKAIIMDVMFGGTETVASAIEWAMAEMMHSPNDLLQ
LQQELADTVGIDRNVDEPDLNKLSFLKCVIKETLRLHPPIPLLHRENAEDCVLGGYSVPQ
GSSVNINVFAMGRDTKVWKDADTFRPSRFMEGEGEAAGVDFKGGCFQFLPFGSGRRSC
PGMALGLYSLELVIAQLAHGFNWALPNGEKPSVLDMSDIFGLTAPRATRLWVVPTPRLT
CPLVVDV SEQ ID No: 41
>Rice_Os03g0112900
MANGVAEYLLMDPWLVLWLVLASMAFALLHLRRRARRGAPPLPPGPRPLPII
GNMLMMDQLTHRGLAAMAARYGGLLHLRLGRVHMVVVSSPEHAREVLQVQDGDFSN
RPASIAIAYLTYGRADMAFSHYGHFWRQVRKLSAVRLFSRRRAQSWRAVRDESAKLVG
AIARRAGEAVDLGELIFGLTKDVIFRAAFGTRDGGGHGELEVLLQEFSKLFGAFNVGDFI
PWLAWLDPHGINRRLRAARAALDSVIDRIIDEHVSNPAGDEDADMVDDMLAFLDEAGR
DQTGGGGELQGTLRLTRDNIKAIIMDVFGGTETVASAIEWAMAELLHSPGDLRRLQAE
LADVVGLGRGVEEGDLEKLPFLRCVAMETLRLHPPIPLLLHEAAADCVVGGYSVPRGA
RVVVNVWSVGRDAGAWKGDAGAFRPARFMAGGEAAGMDLRGGCFELLPFGSGRRAC
PAIVLGMYELELVVARLVHAFGWAPPGGVAPEELDMADGFGLTAPRAARLRAVPTPRL
TCPM SEQ ID No: 42
>Rice_Os10g0512400
MADMVKFTMEWLQDPLSLAIVVTVAVLIIVIRMQRRRAAPFPPGPKPLPIVGN
MAMMDQLTHRGLAALAKEYGGLMHLRLGRLHAFAVSTPEYAREVLQAQDGAFSNRP
ATTAIAYLTYDRADMAFAHYGPFWRQMRKLCVVKLFSRRRAETWLAVRDESAALVRA
VAASRGEAAVNLGELIFNLTKNVIFRAAFGTRDGEGHDEFTAILQEFSKLFGAFNIGDFIP
WLSWADTNGINARLVAARTALDRFIDKIIDEHMERGKNPDDADADMVDDMLAFLAEA
KPHAGKAAAAAAGAGDGADDLQNTLRLTRDNIKAIIMDVMFGGTETVASAIEWAMAE
MMHSPDDLRRVQEELAAVVGLGRDVAESDLDKLPFLRCVIKETLRLHPPIPILLHETAAD
CLVAGYSVPRGSRVMNVWAIARDRAAWGPDADAFRPSRFAAGAAAEGLDFRGGCFE
FLPFGSGRRSCPGMALGLYALELAVARLAHGFNWSLPDGMKPSELDMSDIFGLTAPRAT
RLSAVATPRLTCPLY SEQ ID No: 43
>Maize_A0A0B4J2X1
MVTVAKIAMEWLQDPLSWVFLGTLALVVLQLRRRGKAPLPPGPKPLPIVGN
MAMMDQLTHRGLAALAERYGGLLHLRLGRLHAFAVSTPEYAREVLQAQDGAFSNRPA
TIAIAYLTYDRADMAFAHYGPFWRQMRKLCVMKLFSRRRAETWVAVRDECAALVRAV
ASGGGGGEAVNLGELIFNLTKNVTFRAAFGTRDGEDQEEFTAILQEFSKLFGAFNVVDF
LPWLSWMDLQGINRRLRAARSALDRFIDKIIDEHVRRGKNPDDADADMVDDMLAFFAE
AKPPKKGPAAAADGDDLHNTLRLTRDNIKAIIMDVMFGGTETVASAIEWAMAEMMHSP
DDLRRLQQELADVVGLDRNVNESDLDKLPFLKCVIKETLRLHPPIPLLLHETAGDCVVG
GYSVPRGSRVMNVWAIGRHRASWKDADAFRPSRFTPEGEAAGLDFKGGCFEFLPFGS
GRRSCPGTALGLYALELAVAQLAHGFNWSLPDGMKPSELDMGDVFGLTAPRATRLYA
VPTPRLNCPLY SEQ ID No: 44
>Maize_B4FWF9
MAAAVANIGMEWLQDDPLSWVFLGTVCLVVLQQLRRRRGKAPLPPGPKPLPI
VGNMGMMDQLTHRGLAALAETYGGLLHLRLGRLHAFAVSTPEYAREVLQAQDGAFSN
RPATAAIAYLTYDRADMAFAHYGPFWRQMRKLCVMKLFSRRRAETWAAVRDECAAL
VRAVAVGGGSGGEAVNLGELIFSLTKNVTFRAAFGTRDGEGQEEFTAILQEFSKLFGAFN
VGDFLPWLGWMDLQGINRRLRAARSALDRFIDKIIDEHVRRGKSPDDADADMVDDML
AFFVEATPGKATGAAAAADGGDDLHNTLRLTRDNIKAIIMDVMFGGTETVASAIEWAM
AEMMHSPDDLRRVQQELADVVGLDRNVSESDLDRLPFLRCVIKETLRLHPPIPLLLHET
ADDCVVAGYSVPRGSRVMVNVWAIGRHRASWKDADAFRPSRFAAPEGEAAGLDFKG
GCFEFLPFGSGRRSCPGMALGLYALELAVAQLAHAFNWSLPDGMKPSEMDMGDIFGLT
APRATRLYAVPTPRLNCPLY SEQ ID No: 45
>Soybean_G3E7M3
MANLDLDPFQTSILILVPIALLVALLSRTRRRAPYPPGPKGLPIIGNMLMMEQL
THRGLANLAKHYGGIFHLRMGFLHMVAISDPVAARQVLQVQDNIFSNRPATIAISYLTY
DRADMAFAHYGPFWRQMRKLCVMKLFSRKRAESWQSVRDEVDAAVRAVASSVGKPV
NIGELVFNLTKNIIYRAAFGSSSQEGQDEFIKILQEFSKLFGAFNIADFIPYLGCVDPQGLN
SRLARARGALDSFIDKIIDEHVHKMKNDKSSEIVDGETDMVDELLAFYSEEAKLNNESD
DLQNSIRLTKDNIKAIIMDVMFGGTETVASAIEWAMAELMRSPEDQKRVQQELADVVG
LDRRAEESDFEKLTYLKCALKETLRLHPPIPLLLHETAEDATVGGYFVPRKARVMINAW
AIGRDKNSWEEPETFKPARFLKPGVPDFKGSNFEFIPFGSGRRSCPGMVLGLYALELAVA
HLLHCFTWELPDGMKPSEMDMGDVFGLTAPRSTRLIAVPTKRVVCPLF SEQ ID No: 46
>Soybean_I1J8P0
MANLDLDPFQTSILILVPIALLVALLSRTRRRAPYPPGPKGLPIIGNMLMMEQL
THRGLANLAKHYGGIFHLRMGFLHMVAISDPVAARQVLQVQDNIFSNRPATIAISYLTY
DRADMAFAHYGPFWRQMRKLCVMKLFSRKRAESWQSVRDEVDAAVRAVASSVGKPV
NIGELVFNLTKNIIYRAAFGSSSQEGQDEFIKILQEFSKLFGAFNIADFIPYLGCVDPQGLN
SRLARARGALDSFIDKIIDEHVHKMKNDKSSEIVDGETDMVDELLAFYSEEAKLNNESD
DLQNSIRLTKDNIKAIIMDVMFGGTETVASAIEWAMAELMRSPEDQKRVQQELADVVG
LDRRAEESDFEKLTYLKCALKETLRLHPPIPLLLHETAEDATVGGYLVPKKARVMINAW
AIGRDKNSWEEPESFKPARFLKPGVPDFKGSNFEFIPFGSGRRSCPGMVLGLYALELAVA
HLLHCFTWELPDGMKPSEMDMGDVFGLTAPRSTRLIAVPTKRVVCPLF SEQ ID No: 47
>Soybean_Q2LAL3
MDWQSMMGNLDPFQRTILILVPLTLLLLLLLSRTRPRPPYPPGPKGFPIIGNMF
MMDQLTHRGLANLAKHYGGIFHLRMGFLHMVAISDPDAARQVLQVQDNIFSNRPATIA
ISYLTYDRADMAFAHYGPFWRQMRKLCVMKLFSRKRAESWQSVRDEVDAAVRAVASS
VGKPVNIGELVFNLTKNIIYRAAFGSSSQEGQDEFIKILQEFSKLFGAFNIADFIPYLGCVD
PQGLNSRLARARGALDSFIDKIIDEHVHKMKNDKSSEIVDGETDMVDELLAFYSEEAKL
NNESDDLQNSIRLTKDNIKAIIMDVMFGGTETVASAIEWAMAELMRSPEDQKRVQQELA
DVVGLDRRAEESDFEKLTYLKCALKETLRLHPPIPLLLHETAEDATVGGYFVPRKARVM
INAWAIGRDKNSWEEPETFKPARFLKPGVPDFKGSNFEFIPFGSGRRSCPGMVLGLYALE
LAVAHLLHCFTWELPDGMKPSEMDMGDVFGLTAPRSTRLIAVPTKRVVCPLF SEQ ID No: 48
>Soybean_K7MH28
MDLLLELKTALEPFRETLLFTIPLTLLLLGIVSRIRRKTAPYPPGPKGLPLIGNM
NIMNQLTHKGLANLAKQYGGVLHLRIGFLHMVAISNAEAAREVLQVQDNIFSNRPATIA
ISYLTYDRADMAFAHYGPFWRQMRKICVMKLFSRKRAESWNTVRDEVDFIIRSVTNNL
GSPVNVGELVFNLTKNIIYRAAFGSSSQEGQDEFISILQEFSKLFGAFNVADFVPLGWVD
PQGLNKRLVKARASLDSFIDKIIDEHVQKRRSGHDGDEESDMVDELLNFYSHEAKLNDE
SDELLNSISLTRDNIKAIIMDVMFGGTETVASGIEWAMAELMRSPDDLRRVQQELADVV
GLDRRVEESDLEKLVYLKCAVKETLRLHPPIPLLLHETAEDAAVCGYHVPKGSRVMINA
WAIGRDKSAWEDAEAFKPSRFLNPHVPDFKGSNFEFIPFGSGRRSCPGMQLGLYTLELA
MAHLLHCFTWELPDGMKPSELDTSDVFGLTAPRASRLVAVPFKRVLCPL SEQ ID No: 49
>Soybean_I1LHY5
MDWQSMMGNLDPFQRTILILVPLTLLLLLLLSRTRPRPPYPPGPKGFPIIGNMF
MMDQLTHRGLANLAKHYGGIFHLRMGFLHMVAISDPPAARQVLQVQDNIFSNRPATIA
ISYLTYDRADMAFAHYGPFWRQMRKLCVMKLFSRKRAESWQSVRDEVDSAVRAVANS
VGKPVNIGELVFNLTKNIIYRAAFGSSSQEGQDDFIKILQEFSKLFGAFNIADFIPYLGRVD
PQGLNSRLARARGALDSFIDKIIDEHVQKKNNYQSSEIGDGETDMVDELLAFYGEEAKL
NNESDDLQNSIRLTKDNIKAIIMDVMFGGTETVASAIEWMSELMRSPEDQKRVQQEL
ADVVGLDRRVEESDFEKLTYLKCALKETLRLHPPIPLLLHETAEDATVGGYFVPRKARV
MINAWAIGRDKNSWEEPETFKPARFLKPGVPDFKGSNFEFIPFGSGRRSCPGMVLGLYA
LELAVAHLLHCFTWELPDGMKPSEMDMGDVFGLTAPRSTRLIAVPTKRVVCPLF

SEQUENCES

SEQ ID No: 50
>Artichoke_KVI02897.1
MDVLQLQGLLHPMPILFYVALPLLTFFLLSSFRRKPLPPGPRGWPLIGNMLM
MDQLTHRGLASLADKYGGLLHLKMGFSHTVAVSSPEMARQVLQVQDNVFANRPATIAI
TYLTYDREDMAFANYGPFWRQMRKLCVMKLFSRKRAESWDSVRDEVVSMIKITAASS
GSAVNLGELVFGLTHDIIYRAAFGSISHEGKEEFIRILQEYTKLFGAFNLADFIPWLGFIDP
AGLNTRLPKARGELDGFIDKIIDEHLRKEKKTGDDADNDMVDEMLAFYSEEGKVNEGE
DLQNAIRLTRNNIKAIIMDVMFGGTETVASAIEWALTELMHTPEALKRAQQELADVVGL
DRRVEESDFEKLTYFKCIIKETLRLHPPIPVLLHQSSEATEVAGYHIPKGTRVMVNAYAIN
RDKNAWKDPNTFNPSRFLENGAPDFKGSNYEFLPFGSGRRSCPGMQLGLYAMEMAVA
HLLHSFTWQLPDGMKPSEIDMTDVFGLTAPKATRLVAVPTPRLLCPLY SEQ ID No: 51
>Artichoke_KVH92322.1
MDSIQIPISIYVIIALLTFSFLAWLRRKNLPPGPMGWPVIGNMLMMDQLTHRG
LARLAEKYGGILHLKMGFRHTIAVSSPEIARQILQVQDNIFANRPATIAITYLTYDRVDM
AFADYGPFWRQMRKLCVMKLFSRKRAESWDSVRDEVDSMVTTTATNSGLPVNLGELV
FGLTHDIIYRAAFGSTSHEGKEEFIRILQEYTKLFGAFNLADFIPWLGFIDPAGLNTRLPAA
RAALDGFIDKIIDQHLAKEKKVGDENVDNDMVDEMLAFYSEEGKTNEAEDLQNAIKLT
RDNIKAIIMDVMFGGTETVASAIEWAMTELMHTPEALKLVQQELTNVVGLDRRVEESD
FEKLPYFKCVIKETLRLHPPIPVLLHQSSEATEVSGYHIPKGTRVMVNSYAINRDKNAWT
DPNTFNPSRFLQNGAPDFRGSNYEFLPFGSGRRSCPGMQLGLYAMEMAVVHLLHCFNW
ELPDGMKPSEIDMGDVFGLTAPKAIRLVAVPTPRLLCPLY SEQ ID No: 52
>Radish_GSRAST00026355001
MESSISQTLGQVLDPTTGILIVVSIFIFIGLITRRRPPYPPGPRGWPIIGNMSMM
DQLTHRGLANLAKKYGGLCHLRMGFLHMYAVSSPDVAKQVLQVQDSVFSNRPATIAIS
YLTYDRADMAFAHYGPFWRQMRKVCVMKVFSRKRAESWASVRDEVDKMIRSVSNNV
GKSINVGEQIFALTRNITYRAAFGSACEKGQDEFIRILQEFSKLFGAFNVADFIPYFGWIDP
QGINKRLVKARNDLDGFIDDIIDEHMKKKENQNTADDGEVVDTDMVDDLLAFYSEEAK
LVSEATELQNSIKLTRDNIKAIIMDVMFGGTETVASAIEWALTELLRSPEDLKRVQQELA
EVVGLDRHVEESDIEKLTFLKCTLKETLRLHPPIPLLLHETAEDTEIDGYFVPKKSRVMIN
AFAIGRDKNSWVDPETFRPSRFLEPGVPDFKGSNFEFIPFGSGRRSCPGMQLGLYALELA
VAHILHCFTWKLPDGMKPSELDMSDVFGLTAPKATRLYAVPSTRLICAV SEQ ID No: 53
>Radish_GSRAST00007419001
MESSVSQTLSQVFDPTTTILIVVSVFIFIDLITRRRRSYPPGPRGWPIIGNMLMM
DQLTHRGLANLAKKYGGLCHLRMGFLHMYAVSSPDVARQVLQVQDSIFSNRPATIAIS
YLTYDRADMAFAHYGPFWRQMRKVCVMKVFSRKRAESWASVRDEVDKMIRSVSSNV
GKSINVGEQIFALTRNITYRAAFGSACEKGQDEFIRILQEFSKLFGAFNVADFIPYFGWIDP
QGINKRLVKARNDLDGFIDDIIDEHMKKKENQNTVDDGDVDTDMVDDLLAFYSEEAKL
VSETTDLQNSIKLTRDNIKAIIMDVMFGGTETVASAIEWALTELLRSPEDLKRVQQELAE
VVGLDRHVEESDIEKLTFLKCTLKETLRLHPPIPLLLHETAEDTEIDGYFVPKKSRVMINA
FAIGRDPKSWPDAETFRPSRFLEPGVADFKGSNFEFIPFGSGRRSCPGMQLGLYALELAV
AHILHCFTWKLPDGMKPSELDMNDVFGLTAPRATRLFAVPSTRLICAV SEQ ID No: 54
>Radish_GSRAST00001088001
MESLLSQNLNHVIDPIPSALLITISLLVVVYLISQWLKPLYPPGPKGLPVIGNML
MVNQLTHHGLAKLANRYGGLFHLRMGFRHVFAITSPDVARQVLQVQDISFSNRPVTVA
INYLTYDLADMAFAPYGPFWRQMRKVCVMKVFSRKRAESWASVREEVNNMVRSLSSN
DVGKPVNVGDLIFTLTRNITYRAAFGAACETEQDEFIRILQEFSKLFGAFNIADFIPFLGW
LDLQGINKRLVKARNDLDGFIDEVIDEHMKKRETINGDEDTDMVDDLLAFYSEDSSPNR
SKNAVKLTRDNIKALVMDVMFGGTEMASGIEWALTELLRNPAELKRLQQELTEVVGL
DQRVDDTHLEKLTFLKCTLKETMRLHPPIPLILHEAIEDTKLQGFSVPKGSRLMINAFAIA
RDPKLWVDPETFRPCRFMEPGMPDFMGTNFEFIPFGAGRRSCPGMQLGLYAMEVAVAN
IIHCFTWKLPDGMKPSELDMSDVMGLTAPRATRLIAVPDTRLICSVWP SEQ ID No: 55
>Radish_GSRAST00042054001
MDCLLCSPILYVVLIFLWYLVRVLVTRGNPFPPGPKGYPIIGNMKLKNQLNHR
GLAELAKQYGGLLHLQMGKIHIVAASTAEMAREILQVQDVVFANRPANVAISYLTYNR
ADMAFANYGPLWRQMRKVCVMKLFSRKRAESWASVRDEINTMVQTLTKQTGSPVNV
GELVFALTRNITYRAAFGSFARDGQDEFVKILQEFSKLFGAFDITEFLPWMKWFSNRDFS
KRLENARKSLDGFIDRIIDAHIEKKNSRKQEDDGLEDDMVDELMAFYSGENGGKSNDSL
STFRLTRDNIKALVMDVMFGGTETVASAIEWAMTELMKNPHELVKLQQELADVIGLNR
QFHESDLENLPYFRCAMKETLRLHPPIPLLLHEAAADSVVSGYSIPRDSRVMINVYAIGR
DGSVWTEPDAFRPGRFMEDKAPDFKGSDFEFLPFGSGRRSCPGMQLGLYAMELAVAH
MLHSFDWKLPEGVSSGDLDMTDMFGLTAPRATRLIAVPSYRLKCPMVI SEQ ID No: 56
>Radish_rs_Aokubi_v1_EVM13601
MYTPMTLILLVPLLLFLYWHLLSRRLRLRKSYPPGPKGLPIIGNILMMNQVNH
RGLAKLSRTYGGLLHLRLGLSHLFVVSSPQIARQVLQVQDHVFSNRPTTIAIRYLTYGQS

| SEQUENCES |
|---|
| DLAFGNYGPFWRRMRKLYVMMLFSRKRAESWASVDEEVHKAVRFVAANVGKPLNIC<br>KVAFSLTRDITFGAAFGSSSSTSDEGRLDEFLEIIQEFSKLFGEFNVADYVPSWLSWIDPQ<br>GINKRVERARKSLDCFIESIINDHLDKKKTENNVDVDEETDMVDQLLAFYKEEVKVKDS<br>ETKINLNNIKGIIMDVMFGGTETVALAIEWVLTELLRSPENMKRVQEELATVVGLERWS<br>VEDTHLEKLTFLKCVLKETLRLHPPFPLLLHETVEDAEVSGYSIPKGSRVMVNTYALGR<br>NPNSWSDPEIFNPSRELDPGAPDLKGNSFEFIPFGSGRRSCPGMQLGLYAFELAVAHLLH<br>CFTWKLPNGVKPGDVDTIEGPGLTVPKANSLVAVPTTRLLSPIVLESHNV<br><br>SEQ ID No: 57<br>>Onion_AC.SP3B.Locus_5396.1.10<br>MMDMQSILIFTLPFVTLLFLVITSRRRPKLPLPPGPRPLPIIGNLNLIDKLTHRGL<br>AHLANQYGGIFHLKLGSVHTFSISTPEIAKEVLQTQDLAFSNRPATIAITYLTYDRADMAF<br>THYGPFWRQIRKLCVMKLFSRKRAESWASVREEIEKAVSTAAAGAGTVVNVGELVFNL<br>TKNITFRAAFGAKSGEEQDEFLGILQEISKLFGAFNVGDFVPGLRYLDPQGIGRRMRKVR<br>KELDGFIDRIIDEHVQNRKEVDDVEADMVDEMLAFVGQGKSIGRDSDELRLTRNNIKAII<br>MDVMFGGTETVASAIEWAMAELLKSPEDLKRLQQELTSVVGLDRKVQDSDLDKLPYL<br>KCVIKETLRLHPPIPLLLHETAEDCEIQGYSIPKKSRVMINVWAIGRDKSAWKDADQFKP<br>SREVKGGEYEQVDFKGNEFELLPFGAGRRSCPGMQLGLYALDLTVANMAHCFDWELP<br>DGMKPGEMDMSDVFGLTAPRAVRLAAVPSPRLTCRI |

| DNA |
|---|
| SEQ ID No: 58<br>>Lettuce_LsF5H_1_1<br>GAAATATATTTCATTTTTAGCACATATTTACCACATAAACACAAGAAATC<br>ACACATAACATACAAATGCACATAGATCTTCACAATTTTACTTGTATTCTCCCCCATA<br>AATCATATGAAAACCGAAAATAGAGGGGTATAAACTCACCTTGAGTTTGTGGATTC<br>AGTTTTTGAAGAAGATGTGGAAAGATGAAATGATTTTTCGGCCCTAGCAACTCCCTT<br>GAGTAGATCTCGAACTCAAGAAGATTTCACAAGTATGTATCTTGGAGTGATTCTTGG<br>ATGAAAACCTTCTTGAATGCCCTTAATCTTGAAAATTTTGTAGGAGGAATGAAGGTG<br>TTCTTGAGAGGATTTGGAAGTGAATTAAGTGTGTGTGTGTGTGTTTGGTGATCCTC<br>GGTCAAGAGTAGAAGAAGAGATGGGAGGGAGTGACGTGAGTTGACATGCATAGAG<br>ATATGAGAATGGTGCATGGATATCCTATGTACATTTATGAGGTGGCACCACAAACCT<br>CATTTCATCTTTTCTTTTATTTATTTTTATTTTTTTTGTTTTACTTGGGCCGAAATGG<br>GCTAAGGAAGGATGAAGGAATCACTTTGGCCCATTCTTTCCTTGGCTCGAGTTCATG<br>AGGCCCATAAGGAAAACTTACGGCCCGTTGGGCCCTTAGGGTAGCTCACGACCCAA<br>ATCTTTATATAAGAGAATGGATTTGAGTCCATCAAAGCTAATTGGATTTGTTATGGC<br>CCAATAAGGCCTATTAAAGATAAACTAGTCCATTTTAGGCTTATAAGGCCCAAAAG<br>GTTAAGTCTCATGAGAGTGGGTCCAATGAGAGCCCATTTAAGAGTTCTAAGCCCAAA<br>ATAGTCAAATTGAAAGCTTATTGGCCCATTAGGCCCAATAAGGAAATTCTAGTTCAT<br>ATATGACTTAAACCGGAATTTCTAGGGTTTTTCAACTTTACTTGATGAATCTAGGTTT<br>GAATGTGTTTCCATAGGTTGAACATCAAGCATAACATGAATTAGGGTTACGAGTTTA<br>CAATAGATAATGTTCCAAGAGTACAGAATTTCCTAGCTAGAATGCTATTTGTGACAT<br>CTGTGCCTAATAGATACTTTGATTTTTAATTATACTTAACTCAAGTAAGTTGAATAAA<br>TATTTTTGTTAATTATAATTTATTGTATTAACTTGAAGCATTTGAATAATAGAAAATA<br>TTTTTGGTTTCTATACATAAATGTAAGTCATATCGAATAACAAACTTGAGGTAGGAA<br>GATAAAAAATAAATCGAAATTTGCATGAGGAGAACAAAACCAAAACAGAATAATTA<br>AATATTATTAAAAAAAACATGTGAGTGGTTGGTAAAGTAACCAATGGTTAAACTCA<br>AATACTCTCTATTTTAATCTAATAATAAGTAATAACAATGTAAATATTTTACATCTTA<br>ACAAGTGGTACATAAAAGAGAATTATTTCTGACATGTCAGATTAATTTCCAAAATTA<br>CTTGTCTTTGTTCATTTATTATATTTAAAAAAGAATATACTTGACGCAATTAGTGTAA<br>CAAGTTATCCAAAAATCCATTACCACCAAAATCAAAACAAATCTAAACATATTTACT<br>CTTACAATCTAAACATAATCATTAAAAAAACTAAATTAAATAAACAATAACCTAAA<br>CAAATAATTTATCTCATATGATTACAAGAATGTAAAATTAATTGGTCGACCAAGTCA<br>CTTGTGCAGTAGCCAGCAACTAGCAACGTTATGCTGACATACAATTCTATCAGATCT<br>AAGCCGAATAAAAATCAAACTATATTTATGTGTAAATAATTGACCGGCACTCTACG<br>TCTTTGTCTCAAGACAAAAGAATTAGTCAAACATTTCCTGTAATTCTCATTTTTAATA<br>TTTATAATAAATAAAATAAAAGAAAAAAAAAATAGTAATATCCATACGACTTCCCA<br>CCTTTCAAACAGGGTGTGCCCGTTTATCTTGTATATAAACACCCCTTTATCTCACTCT<br>TTAGGTAGCAACATTCATCCAGTTGCCACTTAAAACCTCCATTTGAATCAAAATGGA<br>ATCACTTCAAATCCCCATAGCATTCTACGCTATAATAGCTATCTTAACTTTCTTCTTT<br>CTTTCATGGGTCCGCCGGAAACCACTCCCGCCGGGGCCAATGGGGTGGCCAATCATC<br>GGCAACATGTTGATGATGGACCAACTTACCCACCGTGGCTTAGCCCGTTTGGCAGAA<br>AAATACGGTGGTATCCTTCATCTAAAGATGGGTTTCAGCCACACCATTGCAGTGTCC<br>TCGCCGGAGATGGCGAGGATAATACTTCAAGAAAAGATAACATCTTTGCCAACCG<br>TCCGGCAACCATCGCCATCACTTACCTGACTTACAACGGCGTAGATTTGGCTTTTGCT<br>AATTTATGGACCTTTCTGGCGACAAATGCGAAAGCTTTGTGTCATGAAGCTGTTCAGC<br>CGGAAACGAGCGGAGTCATGGGACTCCGTCAGGGGATGAGGTGGACACCATGGTGAA<br>AGCCACCGCCATTAACTCCGGTACGCCGGTAAACTTGGGTGAGCTTGTTTTTGGGTT<br>GACCCATGATATTATCTACCGAGCAGCTTTTGGGTCGATTTCACATGAAGGGAAGA<br>AGAGTTTATCAGAATCCTTCAAGAATACACCAAACTTTTTGGCGCATTCAATTTGGC<br>TGACTTTATCCCGTTCCTCGGGTTTATTGATCCGGCGGGGTTGAACACACGTTTACCG<br>GCGGCCAGGGCGGCGTTGGACGGATTCATTGACAAAATCATCGACGAGCATTTGCG<br>TAAAGGAAAGAAAACCGGCGATGAAGGTTTGGATAACGATATGGTTGATGAGATGT<br>TGGCGTTTTACAGCGAGGAAGGAAAAGTCAACGAAGGTGGTGATTTGCAAAACGCC<br>ATTAACCTTACTCGAGATAACATCAAAGCCATAATCATGGTAAGTAATGAAACCATG<br>AATACATTCTTTTTATAAATCATTATAACATTCCAAATTCTAAAAGTTAATCCAAAAC |

| SEQUENCES |
|---|
| TTTTGTAGGATGTAATGTTCGGTGGAACTGAGACAGTGGCGTCCGCCATAGAATGGG |
| CCATGACGGAGCTAATGCATACACCGGAGGCACTAAAGCGCGTGCAACAGGAGATG |
| GCAAATGTCGTCGGACTTGACCGGCGCGTGGAGGAGTCTGACTTGGAGAAGCTGAC |
| GTACTTCAAATGCGTCATCAAGGAAACCCTCCGACTACACCCTCCGATCCCAGTTCT |
| CCTCCACCAGTCTTCGGAGGCGACAGAAGTTTCCGGCTACCATATACCTAAAGGAAC |
| ACGTGTCATGGTGAACGCGTATGCTATTAATCGTGATAAGAACTCTTGGGAAGATCC |
| GGATACGTTTAACCCGTCACGTTTTTACAAAACGGAGCTCCGGATTTTAGAGGAAG |
| CAACTATGAGTTTCTGCCATTTGGTTCTGGTCGGAGGTCGTGTCCGGGGATGCAACT |
| AGGGTTGTATGCGATGGAGATGGCGGTGGCCCACCTTTTGCATTGTTTCACGTGGGA |
| ATTGCCGGATGGAATGAAGCCAAGTGAAATCGACATGGGTGATGTGTTTGGACTCA |
| CAGCACCAAAAGCAATAAGATTGGTAGCAGTGCCAACTCCGCGTTTATTATGCCCAT |
| TGTATTGAAATGGTTTTATCATTTATATGTATTTATATGTAGGTTGCATACGGTTTCA |
| AATTGTATAAGATTAAGATATATAATAACACGGAAATATTTTTCATATCATATATAT |
| GGTATCACCATAAGCCTTATTTGAACTCAATGGGATTGTATCGATCTTTATTTTTAAA |
| ATTCATAGGCTTAAGGCCGGTCCAAGAAAACTTGAAGCCCGGGGCAAAACACAAAA |
| ATGGGATTGTAGGGATTATATGGATCTTTATTGTATGGATCTTTATTTTTAAAATTCA |
| TAAAGATATGTGAAAACTCAGAAACGAACTATATATAAAAAGATATTTGCACCTTTA |
| ATATTCGGTAGTAAAAAAATGTCTCTATTTGTATGTTGTTTCATCCAACACACCTTTA |
| TTACAAAGATATACATCACCAAAACTTACCCTTCAACTTAAGGTTCATAGCTAAACT |
| ATACTTCTGAACTTAAGTTTCTATCAAAAACAAAGAAATAAAAAACTAAAAATGATT |
| GATTTTTCCAAAAGATAACATGATACACAGTGTAGTAGATCATTGCACATTGCATAA |
| ATTGCCAACAAATACTAACGTCTACTTCTATCACATTTTTCTTTTTTCACTTATAGTG |
| CTTTAAAAACCTCTTTCGCTATCATCTATAACAACATCATCATTAATTCATTAACATG |
| CATACCTATAATCATAATTAAAAATACAAAAAACTTGCCTAAAATGAAAATGCATC |
| GGGTTCTTGTTCTAGGTTTGCACTTAAATTCAGCCAAAAATGTAGTATGATCTGAAT |
| ACCATTCACAATCAGAGAAGGTCGGATACTCTAGGGGTGAGCAAAACCGAACCCGG |
| AAACCGAAAAACCGACAAAAACCGGCAAAACCGAAACCGAAAAACCGAAACCGAA |
| GCATAAACCGACGGTTTGGGTTTATATTTTTGAAAACCGAAAATTTCGGTTTGGGT |
| TGGGTTTTTGGGTTTGGTAAAACCGATAGAAACCGAACCGAACCGATTATATATACT |
| ATTTGTAAAAATATAATTTATATACAAATATAAATATGTTTATAGAAGTAATGTC |
| AAAAGGATGCGCTGGTTGAGGTGGGTAACGCTCTTGCTTGTGTTTCTGAAGGTTTCA |
| AGTTCGAAACCTGTGGCCAAAATTTTACTTCTTTTATTTTCGCAGCTATATAAACCTA |
| TCCCACATCGACACATGATCGAAACTTTGCTACATATGCTCGCCTACATAAGCTAAA |
| CATACATCCTCTTCAGGTTTATTCAGCTATTAGCTTTGTCCCACATCGCTTGAGGGAT |
| CAAAGTAGAAGCCATTTTCACTTCTATAAAAATGAGGATACGAAATGATAGAAAAA |
| CAGTTTTAGGTTTGGTTTAGTTCAAAAACCGAAACCGAAAACCCGATTTGGAAACCG |
| ATAATCCATAAAACCGAACCCATGGGTTTAGGGTCGGTTAGGGTTCAAATTTTTAGA |
| AACCGATGGTCATCGGTTTGGGTTCGGTTTTAGGGCAAAACCGACCCAAACCGACCC |
| ATGCTCAGCCCTAGGATACTCCTTTGATTCTATACAACACAAAATTCCGAAGCTAAA |
| AAAAAGATTCATAAAAAAAAAAATCGTATTTCAAACAAGAATAAAAAATTTCAAGAA |
| GGCTATGATAAACTAGAACTTATAAAGACATATAATCAGTTTCGTCTCCAATGTCAAG |
| TATAATCGATTTTGTCTCAATTTAAAGAAGATTTTGAGTCTGAGTTTGTAACACTCGT |
| GTTTCTAGCCTAGACATTTATATCGAGGTGATAGTCTAGGTTAACCTTTGTAACTCAT |
| TTTGAAGAAATAAAAGAAATTATGTGAATATTATGTGAATTATGTGTTTTATGCTT |
| AATTATTAGGGCTTAATTAATTAAGAATAAAAATAAGCGTCAAAATTAAAGTGTGA |
| GATAAGCCCGATATCTTTACATAAAGTTGTAGTGGTCCAAACAAGGATTTCAGGGAT |
| ATAAAGAATATCAAAATCCGAGTTATAAAGAAGAAGTTATGACCTGTCGAAGTTTC |
| GCGACAAAACCGGCACGGTGCTGAATGTCGTAAAAAGTGAGTTTTTGATAAACTAC |
| TTTTTAGCCTTAGTAATCTAAACGAAAGTCAT |

SEQ ID No: 59
>Lettuce_LsF5H_2_1
TTTTATTTTGTTTAATTTAATTAATTTTTATTTAGATAAAATAAATGACGAA
AATAATATTTTAAAAAAATTCAAAATTTTCATTTATTTTTCATTTTAAAATATATTTTT
TTTATCCCTAAAAGGAATGACAACGATTGCGTTCTCATGTCTTACAAATATAATAA
TATCACATGACTGTAACTATATATATAGTTTTAGGTTATCTGGATAACAAAAAC
CCTAAAGAAAAATCCTAAAAATCATAAAAATGTATGAAAAAAAAATATTTAAGA
TCACAAATATTTTTTTGACTTTATATTTTAAAAGTGGTAACTTTTTATACAATTTTG
CTGAATTTTTTTTGAAAAAAAAAAACCTATGATTTTTAAGAATATAAAGTCAAAAA
AAGATTTGTGATCTCTAAGTATTTTTTATACATTATTATGATTTTAAATTTTTTTTCGT
TATCCATATAACCTTCTATATATCTATATATATATATATATATATANNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNN

| SEQUENCES |
| --- |
| NNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNN
NNNNNNNNNNNNNNNNNNNNATATATGTGTGTGTGTGTGAAAATAGTCAACTTT
CCAGGATTAAATATAAAATGATATAAATAAATGCAAACTCATTCAAACAGAGGTGC
CGCTGCATCTCATTTCAACCACTGCCCACCCTGTATATATACACATCACTTGATCTTC
CTTTACCTAGCAGCGTTTTCTAGTTGCACTTCATTACGCTCATACTCCAATAGACTTA
CTGAACCGAAACTCTTTGCCGGAAATATGGATCCTAAGTCCATCTTACTTTACGTT
GTACTCCCTCTCTTAACCTTCTTCCTTCTCTCCCGATTACGCCGAAAACCTCTTCCGC
CTGGTCCAAGAGGGTGGCCGCTGATCGGTAACATGTTAATGATGGACCAACTCACCC
ACCGTGGCCTTGCTCGTTTGGGAGAAAAATACGGTGGTCTTCTTCATCTGAAGATGG
GTTTCAGCCATACCGTCGCTGTCTCGTCCCCCGAAATAGCCAGGCAAGTACTCCAAG
TTCAAGACAACATCTTCGCCAACCGCCCGGCCACCATCGCCATTAGTTACCTCACCT
ACGACCGGCAAGACATGGCGTTCGCCAACTACGGTCCCTTTTGGCGTCAGATGCGTA
AGCTTTGCGTCATGAAGCTGTTCAGCAGAAAGCGAGCTGAGTCTTGGGACTCCGTCA
GAGACGAAGTTGTCTCCATGGTCAAAATCACCGCTGCAAGCTCCGGCACCGCTGTTA
ACCTTGGAGAGCTTGTTTTCGGGTTAACCCATGATATCATTTACCGAGCAGCTTTCG
GGTCTATCTCTCATGAAGGAAAAGAAGAATTCATCAGAATTCTACAAGAATACACA
AAGCTTTTTGGTGCTTTCAATTTGGCAGATTTTGTCCCGTGGCTTGGATTTATCGACC
CTGCCGGACTGAATACCCGTTTACCGAAGGCCAGGGCGGCGCTTGACAGATTCATTG
ATAAAATCATCGACGAGCACCTTGCAAAAGAGAGGAAAACGGGCGATGAGGAAGA
TAATGATATGGTGGATGAGATGTTGGCTTTTTACAGTGAAGAAGGAAAGGTAAACG
AAGGCGAGGATTTGCAGAACGCGATTAGACTCACCCGAAACAATATCAAAGCCATT
ATTATGGTAAGTAATTGTTGTTTACATTAATATATAAAAAACAAAACAAAACAAGTT
TTCTGAAAATAGTTGTTTTCGTAGTCATTTTGTTGAATACTAACAAAGTCGTAAATAC
TTTAGCTACTTCTATACGATACATAAAACAATTTTCTGTTGTTTTTGGGTTTTTAATA
TTCTATCCAATAAAAAAGTATAAAACATATCTATTTGATGTCATGTTCAATAAAAAA
AATGTATTAGGTAGAATCCAAAAAGTTGTCAATATTAATTAAGTATTCGAGTTGATC
ACACTGGGATATGGATAGAAATTGACTAATTGATTACACATGATTAATTCCAGTCCA
ACACACCAATACAATTATGTTCTTATCATTGGTTCACAACTATAGTTCTTTGTTTCAT
GTATTTCTTGAACTATATTATTACAATGAATTTATTATGTATTGATTATATCATTGTTT
ATATGTAGGATGTAATGTTTGGTGGGACTGAAACTGTTGCTTCTGCTATCGAATGGG
CTTTAACTGAGCTAATGCACACCCCAGAATCCTTAAAACGTGCACAACAAGAGCTC
GCTGATGTTGTTGGCCTTGATCGTCGTGTAGAAGAATCAGATTTCGAGAAGCTAACT
TACTTCAAATGTGTCATCAAAGAAACCTTACGTCTCCACCCTCCGATCCCTGTCCTTT
TGCACCAATCATCAGAAGCCACGTCGGTTGCTGGCTACCACATACCTAAAGGGACA
CGTGTCATGGTTAACGCATTCGCCATTAATCGTGATAAGAACTCATGGAAGGATCCA
CACACGTTCAACCCATCACGTTTCTTGCAAGATGGGGCACCCGACTTTAAAGGAAGC
AATTATGAGTTTCTTCCATTTGGATCTGGACGTAGATCATGTCCTGGAATGCAACTTG
GATTGTACGCAATGGAGATGGCAGTGGCTCACCTTCTTCATTCATTCACATGGCAGT
TGCCTGATGGAATGAAACCAAGTGAGATTGACATGAATGATGTGTTTGGACTCACTG
CACCAAAAGCGATTCGACTTGTTGCTGTGCCAACTCCTCGGTTGTTGTGTCCGCTGTA
TTGAGAAACGGCGAAAAGTTTGATATTGTGAAAATTTGTTTATGTTGCATCATGCAT
CAAATCAGATTGCTTTTCTTTTACATCTTTCTAGTCATCTTCCATAAAGAAAGATATA
CACAAATTGAATAATGCGTAAAGATTATATTTTCATGTACATTTTGAAATGTTCAAA
CTCCTTGTGTTTCTTGTGTTCATATTATATTTTCTTCCTCAGAGAATTACACGCATGCT
TTGTGTTCATATTTGGGAAAAAAAAAACATATAAGTTTTGCTATCAATGTCATTCCT
GGTAAAAATGAATGTTGTTCTTTATGATGTAGCCTAAATGTCAACTTTTTTAGGTTTT
TCTCCAACTACAACTGATATGATATGCTGCCTGACGAGTGACTGGGCTTCTTCCAAG
TGGGACCTTCCCATTCACAAATTTTTATTATGTTTATTGTCACAATAATGATACTTTT
AGTAATATAAATATTACAAATAAATAAACAAACAAATATACATTCTCTCTCTATCAT
TAGCATATAGATAAAACCGCAATTACATGCATAAAAAAAATATAAACCGCATTATA
TGAACACCGAATTCGACCCGTCAGCTAGAGCCAACGTGCGAATCATGGAAATCAAT
AATATTTTGGGCATGTTACGCTTTGAACATTTCACATCTCAACCAATATGTTCCTATC
ATTATTATTTTGGGCATGATAATGACTTAGGAGGGTAACTACCTCTTATCTGTGTTCA
CATATTGGCAACTTCTTCTTTTTTGTACATAAGAAAGAAACTAACTTGTTTTAACTGT
GTAACATCCAAAAAATCATGACCAAAAATTTTGTTTTTAATTTAATACTAAAACCAT
AATTGTCAAACCATTAATTTAATACTCCAGCATCGGGCCTCGCCCGACATCAGGCCC
CGCCTGGCATCGAGCCCCGCTCGGTATACAAATTTGTCTCTCTTAGGCCCCGCCTGT
CTCCGGGCCCCGCCCGCTAAACACATACAATCATCTAACATGCTAACACATAAATCA
ACATACTCTACTGTATCCCTGTCCTAAGAAACATACTTTGCTAATAATGAGATACAA
AATTTCGTCCGTACCCAACTAGTTCCAGCCAGGGCTTCGGCAGTGCAAGGTGAGTCT
CCTCACTCTGTGAATGGGTCTAAGGCCACAATGCCAGCCCATGTAGTCTATGAGTAG
GAAGACTCGGGGGGGTTAGCCCTAGGCATTGTTTGCTAGTATCTTATTCTAGACCAA
GGACTGATGTCGAGCGAGTGCCTGAGGAATGTTTTCATGTTAGATTATACTTGTTGT
ATGTGTGATACTTGTATGTGCCTGGTAAAGAGGTGAGTGTGGGCGAGCTCCCGTATC
TCATCACTAACTGAGTACGAACGATGTTCTGTATCTCATTATTACCAGAGTATGTTTC
TTAGGACAGGGATACAGTAAAGTATGTTTCTTTATGTGTTAGCATGTTATAGGATTG
TATGTGTTTAGCGGGCGGGCCCCGGAGACAGGCGGGGCCTAAGAGAGACATATATG
TATACCGAGCGGGGCTCGATGCCCGGCGGGGCCCGATGACGGACGGGGGCNATTAA
ATTAATGGTTTGACAATTATGGTTTTAGTATTAAATTAAAAAAGAAATTTTTTGGTCA |

```
TGATTTTTGGGATGTTACAAAGTTAAAACAAGTTAGTTGCTTTCTTATATACAAAAA
ATAAGAAGTTGTCAATATGTGAACACGGATAAGAGGTAGTTACACTCCTAATTTATT
TTCCCTTTGAGTTACCGGTTAAAACAGATATTAGCCGGTAATATTGGTGTAATTTAA
ACAGTTAAAACAAGTTAGTTGCTTTATTATGTACAAAAAAGAAGAAGTTGCTAATAC
GTGAACATGGATAAGAGGTAGTTACCCTCCTAAGTCATTTTCCTAACATTTCACATC
TCAACTAATAGGTTCCTATCATATTACATTATAATATTATATACAAACGTGTATATGT
GTTAGTACATGGATAATGACTTAGGAGGGTAATAACGTTTTGTGGTTGTCCATTTTA
GGTCCCTAACGTATTTTTTGTGTGTATTACACCATTAAGGTTATTATAACCGTTTACA
AATAGTCCTTTTAACAGGAAGAAATCGGTAAAAAGGATTATTTCTATACGGTTATAA
CAACCTTAATGGTGTAATACACACAAAAAATACGTTAGTGAC

SEQ ID No: 60
>Endive_ce_gene1
CAATACGTCCAACTATTGGCTTCATATCTAATGGATACATTTATTCTCTTTT
TTTTCGTGATTTGAGGAGTGCTTTCCTCGTTGCTTTCTTTTTAATCATGCTTCCTTCAT
CATCAAATGTAACATTATTCCTACTCTCGCCGTAAATTTCTTCACTTAATCCAATTTC
CAAATGTGATTGGTGAGGCTTGAAAGTTTCCCCACAGACAACTATTGGTACATCATC
ACATTTCCCGACGTTCTGCATCATCAAAATGAATAAACTTTTCATATTAGAAACCAC
AACCATTATTATTTAATAACATAACGCACATTAAAAGTCTGTCTTCAACGCTGTTACT
CTTGGTTACCACAACATCGTTAATTGTATTCCCGTCGTCCTACATAATCATTAAGTCA
TCAACATGTTAAACTTTTCATATTAGCAAACCACAACCACTATATCACATTGCGTAC
CTTGTCAGGATGCTCATTAGAACTTTGACTTTTGGTAACCAGATAATCCATGGAGAA
ACTGTCCTGCATTAGAAACAAAATCGAATATAAAGAAATATTTTTATTCATGTGACA
ACTTCAATATAAAAATTAGACACCTTGATTACCTCAATATCATCGACAGCTATCTTG
CATACATCCTCATCGGACCTTCGCTTACACAGTAGACCCCCCATGTATACCGTATCC
TCCAACTACGTAAACTCATAAAACAACATCTGTTATATCTATGTATAAGCAGGAACA
TCAACCCAGACAAAATGAAAACCGTTTAGTTCCATGAAAATCGTCAACCTCCCATAC
GTGGGTAACTGAAGCCACGACCTGAAGATTCCCCACAAAAAGCAAACCCTCCAAAT
AACCGTCACTTCTAAATGTATATGGTGATTTAACACCACTTCTAAACGTATATGGTG
ATTTAACACGGTTGAGATTGAAAATTGGGAAGATCGAACGGCCAGAATTATTGGAG
AAAAAATAGGACTCGTTAGGAACATTAAAGACATAATTTGACAATCCCTCCGTAATT
TTATAACTTTCTAACGTTTTGTTAGCATTATAAATTAAGACGTTCAAACAAAAAAAA
GGCACTTTAAAGTAAAGTATTTCTACCGCATGATATTATTTTCCAACATCACCTTTCT
TTCTTTGTCGAATATTATATTAAACAAAACAATGTTTATGATATAATCATTCTCTGTT
CTATAAAAATAGTTAGTCTTCTATATACTTGATGTGATTAGTGTAGTAATTTATACGA
AGAACTATTTTAACCTGTATGAAACAAAAACAATTATGGTTTTTGATGGTGGACTAA
TTAACATAATATTTAAATATAGAAAGTTAATAAGCAACAACCTTAACTAAGAAATTA
TGTCAATTGAATACATGAACAGAAAATTAATTCGAAGACCAATTCACTTGGTGTAGC
AACTAGTAACTAGTAACATTATGCTGACATTTAATCTTATTATATAAAATAAAAAAA
TAAAACTCTTTATATGATAATTTAGACCGGCACTCGTTTGCAAGACATAAGAATTAG
TCAACATTTCATGCATGTGATTCTCACTTATAATAACACAAAGTAAAAAGGAGTAAA
TTGCAAAACTGGTCCTTAAATTTTACTTAGGATTAAAAATTCAGTTAAAAATTTTAA
ATTATCACGATGTCGTCCATAAATTTGAATTTTGTTGATATGCTCTTTGGGATTTTCT
CAACAGTACACGTTTATTCTTGATTTTAAAGTCATATTATATGTATTCGGAACCATAT
TTGCGACAAAATACAAACTTAAAGAATGATATTATTATAAATAATTTGTAAAATTGC
AATATTTGGTAAAGCACATGGACATGATTTGTAATTTATATAGTAATATCTATTTGA
ATTCCGGCCATTCAAACGGGGTGTGCCCGCTTAACGTGTATATAAACACCCCTTTAT
TTCACTCTTTAGGTAGCAACATTCAACCAGTTGCCACTTAACTCTCCATTTGAATCAA
TATGGATTATCTTCAAATCCCTATACCAATCTACGCTATAATCGCCATCTTAACCTTC
TTCTTTCTGGCATGGCTCCGCCGTAAGCCACTCCCGCCAGGCCCAATGGGGTGGCCA
ATCATCGGCAACATGTTGATGATGGACCAACTTACCCACCGTGGTTTAGCTAGTTTG
GCGAACAAATATGGTGGCATCCTCCATTTAAAAATGGGTTTCAGCCACACCATTGCC
GTGTCATCGCCGGAGATAGCTCGGCAAATACTTCAAGAAAAAGATAACATCTTTGCC
AACCGTCCGGCCACCATCGCCATCACGTATCTTACCTACAACCGCGTAGATATGGCG
TTTGCAAACTACGGACCATTCTGGCGGCAGATGCGGAAGCTTTGTGTCATGAAGCTG
TTCAGCCGTAAACGAGCGGAGTCATGGGACTCCGTCAGGGATGAGGTGGATACCAT
GGTGAAGGCCACCGCCACTAACTCCGGGTTGCCGGTAAACTTGGGTGAACTCGTATT
TGGGTTGACCCATGATATCATTTACAGGGCGGCCTTCGGGTCGATTTCCCACGAAGG
TAAAGAAGAATTCATCAGAATCCTGCAAGAATACACCAAACTCTTTGGCGCATTCAA
CTTGGCCGACTTTATTCCAATGCTCGGGTTCATTGACCCGGCAGGGTTGAATACACG
TTTACCGGCGGCCAGGGCGGCGTTGGACGGATTCATCGACAAAATCATCGACGAGC
ATTTGAGTAAAGAAAAGAAAACCGGCGAYGAAAATGTRGATAACGACATGGTTGAC
GAGATGTTGGCGTTTTACAGCGAAGACGGAAGAATCAACGAAGGCGGTGATTTGCA
AAACGCTATTAACTTGACACGAGATAACATCAAAGCCATAATCATGGTACGTAACTT
ATGTAACTCGAATAAACTAATAACTATAGATCTTTCTAATATTTAAAACTATTGTTCT
AAAGAAAAACTATACGTAAATTTTGCAGGATGTAATGTTTGGTGGCACTGAGACGG
TGGCTTCCGCCATAGAATGGACCATGACGGAGCTAATGCATACACCGGAAGCACTA
ARGCGCGTTCAACAAGAGTTGACTAACGTTGTCGGTCTTGACCGCCGTGTCGAAGAG
TCTGACTTYGAGAAGCTAACCTACTTCAAATGTGTCATCAAAGAAACCCTCCGGATG
CACCCTCCGATCCCAGTTCTCCTCCACCAATCATCGGAGGCGACAGAAGTTTCCGGC
TACCACATCCCTAAAGGGACACGTGTGATGGTCAACGCRTATGCCATCAATCGTGAC
AAAARCTCTTGGGAAGATCCCGATACTTTCAACCCATCCCGTTTTTTACAAAACGGA
GCTCCTGATTTAGGGGAAGCAACTATGAATTTCTTCCGTTTGGTTCTGGTCGGAGGT
CGTGTCCGGGAATGCAACTTGGGTTRTATGCGATGGAGATGGCGGTGGCCCACCTTC
TTCATTGTTTCACGTGGGACCTGCCCGACGGAATGAAACCAAGTGAAATCGACATGG
GTGATGTGTTCGGACTCACCGCACCAAAAGCAATAAGGCTAGTGGCTGTGCCAACTC
CGCGTTTATTATGTCCATTGTATTGAAATAATTGTATGTAAGTTTTTTAGAGTTTCAT
```

| SEQUENCES |
|---|
| TTTATACCAGATATATATAATAACATGGAAATATTTTTCTTATTGATCTTTGCTAATA
TATTACTAAATCAACAAACCTAGTTGGAACTTGAAGTGTTTACTGGATCTTTATTTCC
CAGATTGTGACGACTTGTAAAAGTCCGTGTAATCCATGTGTGAAACATTTGGCGATG
AAAAACTCATTGGTGAATATAAATTAGTAGAAAAAAGTCTTTTCATGACACACAATT
TTGTCATAAATGGCCACAAATGTCTGTAATTGAAAACACAGTCCTAAATGAAAGAC
GACAGACTTTTTTATCATAAATTTACGATATACATTATGATAGATAATTACGACGTA
CAATGACTGTTGTAAACGACTAAAGATGACAAAGTCTATCATTGAAAACTCCGTCGA
AAATCTAAGATGACAGACATTTTCCGTAAAAATACGACATACATTTTTGACAAACAA
TTACGACAGACATTCAAGGCATACATCTATCACATATATTAATGACTGACCTTTTGT
ATGTCGTAATTTGACAAACTTTTTTGACATACATTTTAGTATTTCATAATTTTACGTTT
TTTAAGAATATATTTTTTTCTCTAAAATGTACCAATATTAATCAAAATAAACACACAT
TTAATATATGATAATACAAATTAAGATAAATATACAAAAAGTCAATCCATCGCACA
AATTCTAGTATGTCAAATACAAAGTACCATATGTTTATCAAAAGTAATTGTCAAAT
ACACAATATCATCGGCGGTAAATAAAGGTTGTGACATAAGTAGCCAAATCTTCACG
CACCTCATCAAGCTCAACGTTCGTATATTCATTCTTCCCCCAAAAATGAAACAAAAG
TTAATATATTAGCCATAAAAAACAATTTTAAACAATTACTTGAAAATTGATCTATTTT
AAACAATTTTACTTGCGTTGTTATCCAACACTTTGACTCCTTCATCGACAACTGCTTT
CATGAATTTAAGACATAATACCGGCATTTTGTGCCACCTGGCTGCATCGGACACTAT
ATAAATACATAATAAATGGTTAGTCAAAAAATATATTAGACAAATCATGAAGTTAA
AGCTGTAGTTTGTGCTCACCAAGACATTTATCCACCTCACACTAATCCTTTTGTTGGA
ATCACATTGTGTTGCATATAAAGATAATGCTCTACAATAAATTGGATGAAATATATA
ACAACAAAATAAAATAATGTGTGATAATTTATATTACTTATGCTTTAATCATTTGCT
TCAATTTTGTATTAACATTTGCAGTCCTTATAGAATCAAGGTAATAGCAGGTGGTTTT
TTGCATGCTTAGTACGACTAGAACCCAATAGCCACTGCAGACCAAAAAGCCAAATA
AAAATTAAGGCAAATACCTCTAATGATTAAGTCAACTGAGATAGTATTACTAAAAG
AAGACATGTCCAAATTAAACATGTCTTCATAAATTAAGACGTTTTTTTACTTAACCC
ATTAAGTCATTCCATCCACACCAGGTAAACTAGAAACATACAAGTATAATTGTTTGG
ATCTAGTTACTAAAATAGTTTAGTACTTTTTGTATTCATAGTCAAATAGAAAATCTAC
CCCGGGATTCTAAGGTAATAAGATGATGTGGTAGTCCTTTCTTGTGAACAACCGAGA
TGTTATGTTTCTACTCTCTTGATCGCCTTTTATGAAGTTTTCCAGTCGTCCATCTTTAG
ATATTGCACTCGATATCACGAAACAGATTCCATGAGCTGTTTTTCCTCCATTCTTGAT
TTCTTCATATAAGTGCCTGTTAAGATACAAAAGCTAAATTCGTTAAATACACAAAT
ATAGTAAATTAGTCAAAATTAAGCACTTACACCCATATAACTAGATATTATAGAACTG
GTCAACTTATGCATTGTAAACACCACTTCAAAACCATCCCAAAATATATATTTGCAA
CAATCAGACTCAACAAACAGTC

SEQ ID No: 61
>Endive_ce_gene2
ATGGATTCTCTTCAAATCCCTATACCAGTCTACGCTATAATCGCTATCTTA
ACCTTCTTCTTTCTGGCATGGCTCCGCCGTAAACCACTCCCGCCAGGCCCAATTGGG
TGGCCAATCATCGGCAACATGTTGATGATGGACCAACTTACCCACCGTGGTTTAGCT
AGTTTGGCGAAAAAATATGGTGGCATCCTCCATCTAAAGATGGGTTTCAGCCACACC
ATTGCCGTATCATCACCGGAGATAGCTCGGCAAATACTTCAAGAAAAAGATAACAT
CTTTGCCAACCGGCCGGCCACGATCGCCATAACCTACCTCACCTACAACGCGTAGA
CATGGCGTTTGCCAACTACGGACCTTTCTGGCGGCAGATGCGGAAGCTTTGTGTCAT
GAAGCTGTTCAGCCGTAAACGAGCGGAGTCATGGGACTCCGTCAGGGATGAGGTGG
ATACCATGGTGAAGGCCACCGCCATTAACTCCGGTTTGCCAGTAAACTTGGGTGAGC
TCGTATTTGGGTTGACCCATGATATTATTTATCGGGCTGCTTTCGGGTCGATTTCCCA
TGAAGGTAAAGAAGAATTTATCAGAATCCTGCAAGAATACACCAAACTTTTTGGCG
CATTCAACTTGGCTGACTTATACCCAATGCTCGGTTTTATTGACCCGGCTGGGTTGAA
TACACGTTTACCGGCGGCCAGGGCGGCGTTGGATGGGTTCATCGACAAAATCATCG
ACGAGCATTTGAGTAAAGAAAAGAAAACCGGCGACGAAAATGTGGATAACGACAT
GGTTGACGAGATGTTGGCGTTTTACAGCGAGGACGGAAGAGTCAACGAAGGTGGAG
ACTTGCAGAACGCCATTAACCTGACTCGAGATAACATCAAAGCCATAATCATGGAT
GTGATGTTCGGTGGCACTGAGACGGTGGCTTCCGCCATAGAATGGACCATGACGGA
GCTAATGCATACACCGGAAGCACTAAAGCGCGTTCAACAAGAGTTGACTAACGTTG
TCGGTCTTGACCGCCGTGTCGAAGAGTCTGACTTTGAGAAGCTAACCTACTTCAAGT
GCGTCATCAAAGAAACCCTCCGGATGCACCCTCCGATCCCAGTTCTCCTCCACCAAT
CATCGGAGGCGACAGAAGTTTCCGGCTACCACATCCCTAAAGGGACACGTGTGATG
GTCAACGCATATGCCATCAATCGTGACAAAAACTCTTGGGAAGATCCCGATACTTTC
AACCCATCCCGTTTTTACAAAACGGAGCTCCTGATTTTAGGGGAAGCAACTATGAA
TTTCTTCCGTTTGGTTCTGGTCGGAGGTCGTGTCCGGGAATGCAACTTGGGTTGTATG
CGATGGAGATGGCGGTGGCCCACCTTTTGCTTTGTTTCACGTGGGAACTACCCGACG
GAATGAAACCGAGTGAAATCGACATGGGTGATGTGTTCGGACTCACCGCACCAAAA
GCAATAAGGCTAGTGGCAGTGCCAACTCCGCGTTTATTATGTCCATTGTATTGA SEQ ID No: 62
>Endive_ce_kethel_v0.1_EVM71979
TTCCTTAAAAGGATGTATGGAATATGAAATTCCAATTCAGGAACTTTGTTT
TAAAAATAAAGTGCATCAGACCTGACCTAACATGACTTGGTATTCGTAATAATAGAC
ATCAAGAATCAGAAAACATATTTTCTGAAAGTACATTGCTATCGAAAGCACCATTTC
ATAAAAAAATTAAAAGAACTTGCAGACTCAGACCTGACTTGGAAAGAATAATCATA
AAAAAAATACAAAAATGAAATAAAATCTCTCAAAATACATTGCTATTAGAATTACC
ATTTTAGAGTGATCTTTTTCCAAAAGAATTGCATCCCACTCAGGTAAACTGGATT
GAACCTACTTCTACAGATGACTATAAAATTGATGTAATTTTTTGTCTGACTTTTGTCA
CATATTATGAAAATGATAGGATGGAGTTCTGCTTGGCCTAAAATTTTTCAGTTGTTG
AATTTGAATGTTATTTAGCTACCGTATTCAAGCATTAATAAAGTGAATTTGATTCTTT |

| SEQUENCES |
|---|
| ACAATACCTTTTTGACTCCTGTATACATTGGTCCCAAAATAGCTCCTCTCTTTTAAAA |
| AACAATGACAAAACTATGAATCAATTACCAGAAAGAGGAAATGGGGTTGAAATTGT |
| TCATTCATGAAACCAAGTTAAGTCATACGCCTCCATAATCTAGATAAGTAAGTAACT |
| GAAACCACAGTAGTCACCAATGGAATTCAAACAAGAAACAATATTATAAAAACAAA |
| TTAAAAAAGAATGAATGAAAAAGAAGATGACAGTAAAGTGTCGTTGCTACAAGAAC |
| TTACCAATTGAACCAGAACCATCAGTCCGCTACCACCTTACCAAGGTATCCCTTGAA |
| AGGGTTGAATCAAACTCGGACTTGATTCATGGATTTGCTAATTTATATACACTGAAG |
| CCAAATTAGATAATTTACTCCATATATTTGGTTGTTCAACTTCAACTGTGCATAAAAA |
| TGTCGAAACCAAATCAAATAAAAACCCTAAATGGTGGGATATTTAGGGGATACGAA |
| TGATATTGGTGGAAAAAGAAAATGTGAATGAAACCTGAATCCATTCATCGATCATTC |
| AAAATGAAACCCCGATTCAAGCATTGAGAGTAAAACCTCAAGAATACCATATAGTA |
| AGATGAAGACGTAGTTGCACCGGATGGTTTAACGATGGAAGCAACAACAGGGATGA |
| AAAAAATAGGCTAAACCGGAAGGCGTAGATGGAGGCTGCGAATTATAGATGTTGAT |
| TGCTGTTTTGTGGATGCCGTTTGAGATTTGTGCGTTCAATATCTAATTGAATGCATTC |
| TGTATCTAATGGCTGATTTATCGCCTAACATTCCTGATTTATTGGAGATTTGGATGGA |
| ACTAGTTAATTGTGATTTAATATGATAATAGTACAATAGAGGTTTTGAGCGGGAAAT |
| TAAAAAATTGGCTACACAAGAGGAGGACATGTGGCACTTTTTTTACTCTTTTATTAG |
| AAGCAAAGATATATATACTAGTTATATATATACATGAGCAGAAATTAAAAATATAC |
| AGCAGTAATAGCACAGAAATTATTTTCCTGTATGATAGAGGCATTGTGAGATTGGAT |
| TATTGGAATAAGCTAAATTTTTTTTTTTCCAGATGTGTGGTATATTGTTATTTTCGTTGT |
| AGCACCGGTAAAATAAAAAGAATTTATAAATTTTACCAATTTTCGAAGAAAATTCCA |
| GTCACGAGGGCGCCATGTGCCCTATAGCAATTCAGCCCCTAGTTATCTATGTAAAAG |
| CGGAAATACGAAAATAGTCAACCTTACGGCTTCAAGTATATATAATTATATAATAAA |
| ATGCTAACTCGTTCAAACAGAGCTATGCGCTGCATCCCCTTTCAAGTTCAACTACTG |
| CGCACCCTGTGTTTTTATATATATACACTCGTGTGCTCTTTCTATACTTGGCAACCTT |
| CTCTCAGTTGCACTTCATTACCCATATACTTTAAGATACTCACTGAACATAAATTCTT |
| TCCCGGATACTATGGATCCCATGTCCATCTTACTTTACGTTGTACTCCCTCTCTTTAC |
| CTTCTTCCTTCTCTCCCGTTTTCGCCGGAAACCTCTTCCGCCAGGTCCAAGAGGATGG |
| CCAGTGATCGGGAATATGTTAATGATGGACCAACTCACCCACCGTGGCCTAGCTCGT |
| TTAGGTGAAAAATACGGTGGTCTTCTTCACCTCAAAATGGGTTTCAGCCACACGGTT |
| GCTGTCTCGTCGCCGGAAATAGCCAGGCAAGTGCTCCAAGTGCAAGACAACATCTTT |
| GCCAACCGTCCGGCAACCATAGCCATCAGTTATCTGACCTACGACCGCCAAGACAT |
| GGCGTTCGCCAACTACGGTCCCTTCTGGCGTCAGATGCGTAAGCTCTGCGTCATGAA |
| GCTGTTCAGCCGAAAACGAGCGGAGTCATGGGACTCCGTCAGAGACGAAGTTGTCT |
| CCATGATCAAAATCACCGCTGCAAGCTCCGGTTCCGCTGTCAACCTCGGCGAGCTGG |
| TGTTTGGGTTAACCCATGACATCATTTACCGGGCAGCTTTCGGTTCTATATCCCATGA |
| AGGAAAAGAAGAATTCATAAGAATTCTACAAGAATACACAAAGCTTTTTGGTGCCT |
| TCAACTTAGCCGATTTTATCCCATGGCTAGGATTTATCGACCCCGCTGGACTGAACA |
| ACCGATTACCCAAGGCCCGAGCAGCGTTAGATGGGTTCATCGATAAAATCATTGATG |
| AGCACCTAAGGAAGGAGAAGAAAACCGGCGACGAAGAAGATAATGATATGGTGGA |
| TGAGATGTTGGCGTTTTACAGTGAAGAAGGAAAAGTGAACGAAGGCGAGGATTTGC |
| AAAACGCAATTAGACTCACCCGAAATAATATCAAAGCCATTATCATGGTAAGTAATT |
| TGTTGATTAATATAATATATTTAAAAACAAAACAAGATAAATTTTCAGAAAACCATA |
| GATCTTCTATATGATTTCTAGAAAAGGCATAAAATAATTTTATGTTGGTTTAGGTAAT |
| TATCCGCTTCCATTTTAGTCGTTATTCAATTCAATGAGTATGAAAGCATGATATTCGA |
| TATGATTTTCAATAAAAGAATTGTGTTAGGTGAAGTGGCAAAATATGACAATACTGA |
| TCAAATCACACTGGGATATGGATAGTTTAATACTTTAATTAATTTGACTAATTGATTG |
| AGTTACATATGATTACTTATTCAACACACTAATACATTATGTTTTTTTATTATTAGTT |
| CAGGAAAACATGAATCTTTGTTTAATATATCTTTAACTATTAATCTAGTATTGGTATA |
| AACTTATGATTAAATCATTATCTATATCTATATCTATAGGATGTGATGTTTGGTGGCA |
| CTGAAACTGTTGCTTCTGCTATCGAATGGGCTTTGACGGAGCTCATGCATACCCCAG |
| AATCCCTCAAGCGTGCACAACAAGAACTTGTTGATGTTGTTGGCCTTGATCGTCGTG |
| TAGAAGAGTCCGATTTTGAGAAGCTAACCTACTTCAGATGTGTCATCAAAGAAACTC |
| TCCGTCTCCACCCTCCGATCCCTGTCCTATTGCACCAATCATCTGAAGCCACGGAAG |
| TTGCTGGCTACCACATACCTAAAGGGACACGTGTCATGGTTAATGCATTCGCCATTA |
| ATCGTGACAAGAACTCTTGGAAGGATCCACACACGTTCAACCCATCACGATTCTTAC |
| AAGATGGGGCCCCCGACTTTAAAGGAAGCAACTATGAGTTCCTTCCTTTTGGATCTG |
| GACGTAGATCATGTCCTGGAATGCAACTTGGATTGTATGCAATGGAGATGGCGGTG |
| GCTCACCTTCTTCATTCTTTCACGTGGCAGTTGCCCGATGGAATGAAACCAAGCGAG |
| ATCGACATGAGTGATGTGTTTGGACTCACTGCACCAAAAGCGATCCGACTTGTTGCT |
| GTGCCAACTCCTCGTCTGTTGTGCCCGCTGTATTGATCAGAAAGGGCCGGTTTGTGA |
| TTGTGAGAATTTGTTAATGTTGCATTGAAACAAATTGTTTTTCTTTTTCTTCTTATTTC |
| GGTCATTATCCATAAAGATAGATATAAACAAGATCAATAACCGTAAAGACTTTTATT |
| GTCATGTACATGTTGAAAGTAAAATTTCTTACGTTTCTTGTGTTCATATTATGTTTTCT |
| TCTTCCGAGAATTTTACGCCAGCTTTGTGTTGAATTGCTGAAAAAGACATTAAGTTC |
| GACTATATTAATACTCAAGTTGAAATTGAAATTAGTTGCCCTTTTGTCAAATTAAAA |
| ATGTCAAATATTTATAGGTTCTTCAACTACAACTGATATGAAATGATACCCGATGAG |
| TGACGGGGCTTCTTCCAAGTGGGACCTTCGCATCCTCCAATTTCAGATATATGTCTAT |
| TGTTCACAATAATGATATATTAAATAAAGAAATATTACAAAAATAACCACAAATAT |
| ATATTATGTCTCCGTATCACTCGCATATAGATAACCACATATTACATCAATGATATAT |
| AAAAACAAAATGCTATATCTTTATTACAAAAACTAGGTTAGAAACCCGTGTGTTACA |
| CGGTTGACAATTCATAAAACAAACGTAAACAAAATTATTTTGTAAGGCACTTATATG |
| CCAACCACTTGAACATTTATTACAACATCCGACAGTCTCCCCGTTAACTGCCACACA |
| AACACACTTGTTTTTGGCAATGCACTTTACTCCTTTAACCCGTAATACACTATTTTT |
| ACCCATAATAGCAAGGTACTTACACATCTTTTCCGAAATTGACTATATATACCCTAA |
| AACTTGTTTAATTGTTACAAGTTCAAGTTACTTATTGTTAGTATTAGTGAAGAAATGT |
| AAATACATTGCTATATGGTTAAAAAAAAGTGCAAAGAGATGGTATACTAAAAAGTC |

SEQUENCES

AAAATGTCGCCTAACAGCTCACCCTTTACGTTAAGGGTGATAGTCTTTCTTACAATCT
TAAATGTAATTTTCGTGACGAGGGACGTGTCAACCGATGCTAAAAAATTTGATGAT
GCTTTTATTGGTATGCATTCTTTCCATTTCTATAATATTAATTATTTAATGTTTTTATAT
GTTTTCTTAAAATGGTCCAAAGTTGTTTAAAACTACATTTTCTTTACTCACATAATCC
GTCTATTTAACATTGTAGCATCTGTCCGACAACCAAAATCATATATTAATGAGAGTA
AAATAACTAATAGCTAAAATGTTCCAAGTATTGAAAAATTAAAGATAAAACGTGAT
AATAGGATAGACTATTTGGAGTAAAATTCCCGATAAAAAAATTATGGGTAAACTTTG
TCCTAGGGTTAACTGATTTTTTTTTCAGTTTTGTTCCCAAAAAGGAATCAGATATTTC
TAAAATGGCCTTTAGCTATTACAAACCCAAATGACAGTTCTACAACAAATAAAACCA
AAATGACAAAAAATTACGAAAAGGAAAAATTTTCTGATATGATACTTAAATATTG
TTTTTATTTAACCTGATTTTAGTGGCTGCTTTGAAGAAACTAATAATTTATTTTGGGT
CTGAGTTCAAAGCTAAACTTGACCATCTGACACCAGCACTTCTGACTGATGCATCTT
TGTGGTGAAACTAAGGCAGAGGAAGAGTAATCAAAGCCATCAAGTATTGGTCCATC
ATCTTTCTTAACACCTTAACCTCTTGGGTACATGAGAAAGAATTAATATACGGATAC
CCTATAACACTACAAGGATTAGTGGTTTTAGCGGCGACATAAGTCGCCCCTAATAGT
CCAGAAAGTCGCCCCTAAAGGCATTAGCGGCGACGAGTCGCCCCTAAAAGTGTCGC
TCCTAATGCCTC

SEQ ID No: 63
>Chicory_ci_vitessa_fr_vl_EVM170737
GTATTGTCAACATCAACAACCTCATCCGACTTCCAATTAGCAAGTGACCG
AGTATGCTTCACCTTTTTGTGATTAAACCCCTAGTATAAAGAAAACACATTCAGAAT
ACACATTTTCTTATAAAATATAACCACAATAATACCTCTTCACTTAATCCAATTTCCA
AATGTGATCGATAAGGCTTGAAACTTTCCCCACAGACAACTATTGGTACATCATCAC
ATTTCCTGACGTCCTGTATCATCATAAGGTCATCAAGATGATCAAACTTTTCATATTA
GAAACCACAACCATTATTATTTAATAACATAACGTACATTAAAAGCCTGTCTTCAAC
ACTGTATCTCTTGGTTACCAGAACATCGTTAATTGTATTCTCGTCGTCCTACATAATC
AGCAAATCATCAACATGGTTAAACTTTTCATATTAGTAAACCACAACTACTATTATT
CAATCACATTGCGTACCTTGTCAAGAGGCTCTTTAGAACTTTGACTTTTGTCAACCAC
ATAATCCAACAGAGAAACTGTCCTTCATTAGAAAGAAAATAGAATATAAACAAATA
TTCGTATTCATGTGACAACTTCAATATAAAAATTAGCACATTGATTACCTCAATAT
CATTGATAACTATCTTGCATACATCCTCATCGGACCTTCGCTTGCAGAGTAGACCCC
CCATGTATGCCATATCCTCCAACTACGTAAACTCATAAAACAACATCTGTTATATCT
ATGTATTAACAGGAACATCAACCCAGACAAAACGAAAACCATTTAGTTCCATGAAA
ATCGTCAACCTCCCATACGTGGGTCTAAACTGAAGCCACGACCTGAAGATTCTCCAC
AAAAAGTGAACCCTCCAAATAACTGTCACTTCTAACCGTATATGATGATTTAACACG
GTTGAGATTGAAAGTTGGGAAGATCGAACGGCCATAATTATTGGAGAAAAAGTAGG
ACTTATTAGGAACATTAGAGATATAATTTGACAATCCCTCCGTAATTTTATAACTTTC
TAACGTTTTGTTTTGTTAGCTTTATAAATTAAGACGTTCAAACAAAAAAAAAAAAA
AAAAAAGCACTTTAAAGTAAAGTATTTCTACCGCATGATATTATTTTCCAACATCA
CCTTTCTTTCTTTGTCCAATATTATATTAAACAAAACAATGTTTATGATATAATCATT
CTCCGTTCTATAAAAAGAATTAGTCTTCTATATACTTGATGTGATTAGTGTAGTAATT
TATACGAAGAACTATTTTCACCTGTATGAAACAAAAACAATGATGGTTTTTGATGGT
GGACTAATTAACATAATATTTAAATATAGAAAGTTAATAAGCAACAACCTTAACTAA
GAAATTATGTCAATTAAATACATGAACAGAAAATTAATTCGAAGACCAATTCACTTG
GTGTAGTAACTAGTAACTCGTAACATTATGCTGACATTTAATCTTATTATATAAAT
AAAAAAACAAAACTCTTTATATGATAATTTAGACCGGCACTCGTTTGCAAGACATAAG
AATTAGTCAACATTTCATGTGATTCTCACTTATAATAAACAAAGTAAAAGGAGTAA
ATTGCAAAACTGGTCCTTGAATTTTACTTAGGATTAAAAATTCAGTTAAAATTTTGA
AATTATCACGATGTCGTCCATAAATTTGAATTTTGTTGATATGCTCTCTGGGATTTTC
TCAACAGTACACGTTTATTCTAGATTTTAAAGTCATATTTATATGTATTAGGATTTAGG
AACCATATTTGCGACAAAATACAAACTTAAAGAAGGATATTATAACAATTTGTATAA
TTGCAATATTTGGTAAAGCACATGGACATATTTGTAAACTATAATAGTAATATCTAT
TTGAATTCCGGCCATTCAAACGGGGTGTGCCCGCTTAACGTGTATATAAACACCCCT
TTATTTCACTCTTTAGGTAGCAACATTCAACCAGTTGCCACTTAACTCTCCATTTGAA
TCAATATGGATTCTCTTCAAATCCCTATACCAGTCTACGCTATAATCGCTGTCTTAAC
CTTCGTCTTTGTGGCATGGCTCCGCCGTAAACCACTCCCGCCAGGCCCAATGGGGTG
GCCAATCATCGGCAACATGTTGATGATGGACCAACTTACCCACCGTGGCTTAGCTAG
TTTGGCGAAAAAATATGGTGGCATCCTCCATCTAAAAATGGGTTTCAGCCACACCAT
TGCCGTGTCATCGCGGAGATTGCCCGGCAAATACTTCAAGAAAAAGATAACATCTT
TGCCAACCGGCCGGCCACCATCGCCATCACGTATCTTACCTACAACCGCGTAGATAT
GGCGTTTGCAAACTACGGACCATTCTGGCGGCAGATGCGGAAGCTTTGTGTCATGAA
GCTGTTCAGCCGTAAACGAGCGGAGTCATGGGACTCCGTCAGGGATGAGGTGGATA
CCATGGTGAAGGCCACAGCCACTAACTCCGGTTTGCCGGTAAACTTGGGTGAACTCG
TATTTGGGTTGACCCATGATATCATCTACAGGGCGGCCTTCGGGTCGATTTCCCACG
AAGGTAAAGAAGAATTCATCAGAATCTTGCAAGAATACACCAAACTCTTTGGCGCA
TTCAACTTGGCCGACTTTATTCCAATGCTCGGGTTCATTGACCCGGCTGGGTTGAATA
CACGTTTACCGGCGGCTAGGGCGGCGTTGGACGGATTCATCGACAAAATCATCGAC
GAGCATTTGAGTAAAGAAAAGAAAACCGGCGATGAAAATGTAGATAACGACATGGT
TGACGAGATGTTGGCGTTTACAGCGAGGACGGAAGAATCAACGAAGGCGGTGATT
TGCAAAACGCTATTAACTTGACACGAGATAACATCAAAGCCATAATCATGGTACGT
AACTTATGTAACTCGAATAAACTAATAACTATAGAACTTTCTAATATTTAAAACTAT
TGTTCTAAAGAAGAACTATACGTAAATTTTGCAGGATGTAATGTTTGGTGGCACTGA
GACAGTGGCTTCCGCCATAGAATGGACCATGACGGAGCTAATGCATACACCGGAAG
CACTAAAGCGCGTTCAACAAGAGTTGACTAACGTTGTCGGTCTTGACCGCCGTGTCG
AAGAGTCCGACTTCGAGAAGCTAACCTACTTCAAATGCGTCATCAAAGAAACCCTC
CGGATGCACCCTCCGATCCCAGTTCTCCTCCACCAATCGTCGGAGGCGACAGAAGTT

| SEQUENCES |
|---|
| TCCGGCTATCACATCCCTAAAGGGACACGTGTCATGGTCAACGCGTACGCCATCAAT |
| CGTGACAAAAACTCTTGGGAAGATCCTGATACTTTCAACCCATCTCGTTTTTTGCAA |
| AACGGAGCTCCTGATTTTAGGGGAAGCAACTACGAATTTCTGCCGTTTGGTTCTGGT |
| CGGAGGTCGTGTCCGGGAATGCAACTTGGGTTGTATGCGATGGAGATGGCGGTGGC |
| CCACCTTCTTCATTGTTTCACGTGGGAACTACCCGACGGAATGAAACCGAGTGAAAT |
| CGACATGGGTGATGTGTTCGGACTCACCGCACCAAAAGCAATAAGGCTAGTGGCAG |
| TGCCAACTCCGCGTTTATTATGTCCATTGTATTGAAATAATTGTATGTAAGTTTTTA |
| GAGTTTCATTTTATAAAAGATATATATAAATAATAACATGGAAATATTTTTCTTATTG |
| ATCGTTGCTAATATATTCCTAAATCAACAAACCTAGTTGGAACTTGAAGTGTTTACG |
| GGATCTTTGCTTCCCAGATTGTGACGAATTGTAAAAGTCCATATATCACAATGGAGA |
| ATATCGAAAGGATTATTAGCAACATTGTTGAAAGAAACAAAAGGTAATCTCTTTGTT |
| TAGCTAATGGACACATATGACAAACAGAGTCATTGTCATCTTTATTGCTAATACAAA |
| GATCATTGCGTATTATCCTAATTTTGTCATTAGAGGGATGACCAAATCTTGAATGCC |
| ATTGATGAAGAGAAACAGCCACATTTGCACACACAGTGGTGGATGGGATAGCATGA |
| ACCTTACCCTTGCCAATTATTTTCTTGGGGAAATCTGTTTGATAACAGCATAATCAT |
| GATAGAATTTGACTGTTAGTAACTGTGATTCGGTTAAACAGGTGACTGATATCAGAT |
| TCAGTTCAAATTGTGGAACAAATAGTACATCTCTAAGAAACAACTCATCCGTGAGCT |
| GTATGTCTCCTTTATAATGAACCTGGATGAGACTATGATTTGGTAGTCTTACTCTAGT |
| GCCTCTAATAAAGTGAATATTTGTGAAATGCCTTTGTCATTGCAAATATGTTATGTA |
| GCCCCCGAATCAAGAATCCATACATTTGATAAGTAATGTCCAGAATTAAAACTTAGG |
| ATTCGGTATTTACCTCTAGATGCTCAGGGACATTGGTAGTAACCATATTAGTGGAAG |
| CAAGTTTTCCTGTTAACAAGGAAATAAGACCTTCACACTGTTGCTGAGTAAGACCAG |
| TAACACATCAGTATGTACAGAAGGTTGATTCATTTCTTCTTTATCAATAATAGATTGT |
| TGTTGATCAACATCAACAGAGTTTGCACGAGGTTGATTAGACTGAGTTCTGTATCCA |
| GGAGGGAAGCCATGCAAGCGATAACACTTGTCTTGTGTGACCGATGCGATTACA |
| GTGCGTATGGAGAGGAGAATCTTTTCAAAAGTTTTTGAAAGACTGGTTAGATCTAGT |
| TTTCTTGTTCTTGATGGGTTTTAGTGCAAACAATGAGCTAAAATCCTAAGTTTACATG |
| CACCTTATAAGGATCTATGTTTTTCTCAGATTGAACCTATAACTAAGACCAAAAATA |
| AAAATACAAAAGAATAATTTTATACCTTTTTACCTTTGGAAGCTAGCACCACAATTC |
| TCGTGCCTCTAGTGGCTGACACCCAGAATCAGGCAAGCTAGATGAGCAAGAGAGAG |
| GAAGGAGGAGACTCCTTTTTGGCGTGAGAAATAGGGGAGTCAGGGGCCTCTATTTA |
| TAGTCTCTAGGTGATAAGCACTAAGGAGTATAAATGTCTTATTTAAGATCATGATAT |
| GATAATGTTTTATCAGATAAAAGGATCTGCTTACCATTGCTATAAAAACCCTTATG |
| GGTTTCGGAATCCACCAGGCTCCAAGCCTGTTATTTCGTCCAACCCATTAGGTTAAC |
| CAGATTGACTGTTACCCACCTATTGAACAATTACAATTTAACCACTGTACTTTTAACT |
| AATCCAATTAATCTTAAAAATAATTCCAATTAATTTTTGATTAATTATTAATTATATA |
| TTATTATTTCTAATTAATATATTATTATTATTTTATATTAATATATCATTATTTCTCTC |
| TCTTTATTGGTCATCTAATCATTTGCTAGTTATGAGAGCAACCCAAATAGACTGTGTG |
| TAACACCCAAAAATTTTCGCAACATATTTGAACTTTTAAAACAACATTTATAAGAG |
| AAACTATGATTTTACAAAAGATAAGTATCACAAAACCAAATTATATCGAAATAAAC |
| TTAATAAAGTGCGGAAGCAAAATAATAATAATGTCCCAAAATGGAAATTCTTCT |
| AATAGTGGTATCCCGGTGCTCCAAGTCACACCTC |

SEQ ID No: 64
>Chicory_ci_vitessa_fr_v1_EVM170780
ATGGTCCGGTGTTATCCCACTTATTTTATGCTGATGATGCAATTTTTGTAG
GTGAATGGTCTTTGTCAAACATGAAGAATCTGTCCCGCATCCTTAAGTGTTTTCATGC
TGCATCAGGACTTAAGGTCAATTTTAGTAAATCCAAAGTATTCGGCATTAGTGTGAA
CAATGATCTAGTCTCGAGGTGTGCTCGCGTCCTTGGTTGCGAGGCGGGCTGTTTTCC
GTTCAAGTTTCTTGGAGTTCCTGTGGGGGCTAATATGAACCGAATAAAAAATTGGGA
CGTAATCGTGGACAAGTTCAATGCCAAATTATCATTGTGGAAAGCAAAAAACCTATC
ATTCGGCGGGAGGATCACACTAATTAAGGCAGTACTCAGCAGCTTACCTGTTTATTA
TTTTTCCATTTTTAAAGTGCCTGCAGGTATACTTAAGAAGCTTGAGCGGATACGAAG
AAGCTTTTTGTGGGGTGGCGGGGGTCGAAATCATGGAATACCGTGGGTGGCTTGGA
ACACAGTCATCTGTGACAAGAGTTATGGCGGCCTTGGAGTCGGATCGCTACGTAGCC
TCAACATTGGACTCATGTTAAAGCGGTGGTGGCGTCTCAAATGCAAACCGGAAACA
TTATGGTGCAGAATAATTAGTAGTATACACAACTTGGTGAGGAAACCGGCTCATCAT
CTTGCAAAGAGGTCGGCTACAGGTGCTTGGCTTAATATCGTCAACATCCATGGTGAC
CTAGAGGAGTTTGGATTCAGTTTTGACAGTTTATTCAGGAAGACAGTTGGTTCCGGC
AACAATACTTTATTTTGGCATGATAAATGGCTGAATGATACACCTTTGAAAGATTCA
TATCCAGCCCTTTATGATTTAGACAAACGGAAAATGTGTTATGTTTCAGATAGAATC
ACGATGCAAGGGAGGCAGTGGGCTTGGAGATCTAATCCATGCGCTGCTGATGAGAT
TGACCAGATGTACAATTTGGACCAGGCTTTAAACAGTTATTATCCGTCCAATCGAGA
AGATACCTGGAGGTGTGTGCTTAACAGTACAGGGTCGTTCACGGTGGGGCAATTA
GGGAAATTATCGATAATTATGGTGTTACAAGATCAAGTATAAATGTTCAATGGCTAA
AAAAATACCATTAAAAGTAACATGTTTTGTATGGAGAGCCCTTTTAGGGAAAATCCC
GTCAGCGGAGGCTTTGATTAGGAGGGGAGTACGGCTTGATTCCTCGATTTGTTCATT
ATGTAAATCAAATGTTGAATGCTACAATCATATTCTAGTTGGGTGCAGCTTTGCTAA
GGAAGTGTGGGGAAGATACTGCAGTGGTGTGGGGACCCAATCTCGATAGGAGAAT
CGGTGGAGGGACTGTTACAGAACGTGGCTTATTGGGGAAGGTGTCCGAAGAAAAGG
AGACTCTTGACGGTTGTATCTTACGGTACGTTGTGGTGTCTTTGGAAGTCAATGAAT
GATCAGATCTTTAAAGGTGTATCTTGTAATTCTGACACAATTTGTGATCAAATTAAA
GCGTTGCTGTATACATGGATAAAGTTTAGAGGTGGTAAGTTAGACATTAATCAGGAG
GGGTGGAATTTATCTCCATTGAATACTTTGTAATTTGACTTTGTATCGGCTGTCCGGT
CTTGCATCTCGCTGATCGGTTTTGCCTTTTATTTTATTTATAAATTGTGTTGCCGGTTC
AAAAAAAAACTGTATGCATTTAATGTTGCATTAAATGCATAGATTAGATATTTATATG
TGTTAGGAAACATATTTGCAACAAAATACAAACTTAATGAATGATATTATAATAATT

SEQUENCES

```
TCTAAAATTGTCATATTTGGTAAAGCACATGGACATAATTTGTAATTTATATAGTAA
TATCTATTTGAATTCCGGCCATTCAAACGGGGTGTGCCCGCTCAACTTGTATATAAA
CAACCCTTTATTTCACTCTTAAGGTAGCAACATTCAACCAGTTGCCACTTAACTCTCC
ATTTGAATCAATATGGATTCTCTTCAAATCCCTATACCAGTCTACGCTATAATCGCTA
TCTTAACCTTCTTCTTTCTGGCATGGCTCCGCCGTAAACCACTCCCGCCGGGCCCAAT
GGGGTGGCCAATCATCGGCAACATGTTGATGATGGACCAACTTACCCACCGTGGCTT
AGCTAGTTTGGCGAAAAAATATGGTGGCATCCTCCATCTAAAAATGGGTTTCAGTCA
CACCATTGCCGTATCATCGCCGGAGATAGCTCGGCAAATACTTCAAGAAAAAGACA
ACATCTTTGCCAACCGGCCGGCCACCATCGCTATAACCTACCTTACCTACAACCGCG
TAGACATGGCGTTTGCAAACTACGGACCTTTCTGGCGGCAGATGCGGAAGCTTTGTG
TCATGAAGCTGTTTAGCCGTAAACGAGCGGAGTCATGGGACTCCGTCAGGGATGAG
GTGGATACCATGGTGAAGGCCACCGCCATTAACTCCGGTTTGCCAGTAAACTTGGGT
GAGCTCGTATTTGGGTTGACCCATGATATTATTTATCGGGCTGCTTTCGGGTCAATTT
CCCATGAAGGTAAAGAAGAATTCATCAGAATCCTGCAAGAATACACCAAACTTTTT
GGCGCATTCAACTTGGCTGATTTTATTCCAATGCTCGGTTTTATTGACCCGGCTGGGT
TGAATACACGTTTACCGGCGGCCAGGGCGGCGTTGGATGGGTTCATCGACAAAATC
ATCGACGAGCATTTGAGTAAAGAAAAGAAAACCGGCGATGAAAATGTTGATAATGA
CATGGTTGACGAGATGTTGGCGTTTTACAGCGAGGACGGAAGAGTCAACGAAGGTG
GAGACTTGCAGAACGCCATTAACCTGACTCGAGATAACATCAAAGCCATAATCATG
GTACGTAATGTAATTCGAATAAATTAATTTCTATAGATCTTTATAATATTTAAAACTA
TTATTCTAAACAAAAGCAATACGTATATTTTGCAGGATGTGATGTTCGGTGGCACTG
AGACGGTAGCTTCCGCTATAGAATGGACCATGACGGAGCTAATGCATACACCGGAA
GCACTAAAGCGCGTTCAACAAGAGTTGACTAATGTTGTCGGTCTTGACCGCCGTGTC
GAAGAGTCTGACTTCGAGAAGCTAACCTACTTCAAATGTGTCATCAAAGAAACCCTG
CGGATGCACCCTCCGATCCCGGTTCTCCTCCACCAATCATCGGAGGCGACAGAAGTT
TCCGGCTACCACATCCCTAAAGGGACACGTGTCATGGTTAACGCGTACGCCATAAAT
CGTGACAAAAACTCTTGGGAAGATCCCGACACTTTCAACCCATCCCGTTTTTTGCAA
AACGGAGCTCCTGATTTTAGGGGAAGCAACTATGAATTTCTTCCGTTTGGTTCTGGT
CGGAGGTCGTGTCCGGAATGCAACTTGGGTTGTATGCGATGGAGATGGCGGTGGC
CCACCTTCTTCATTGTTTCACGTGGGAACTACCCGACGGAATGAAACCGAGTGAAAT
CGACATGGGTGATGTGTTCGGACTCACCGCACCAAAAGCAATAAGGCTAGTGGCAG
TGCCAACTCCGCGTTTATATGTCCATTGTATTGAAATAATTGTATCTAAGTTTTTA
TAGTTTCATTTTATACAAGATATAAATAATAACATGGAAATATTTTACTTATTGATCT
CTGTTAATATATTCCCAAATCAATAAATCTAGTTCAAACTCAAAGTGTTTACGGGAT
TTTTTCTTGGCAGATTATGACGAATTGTAAAAGTCCGTGTAATCCAGGTGTAGTTTA
GCCATGAAAAACTCAATGGTCAATATAAATGGCTAATTTTTACGAAATATCTCGATT
CATGTACGTAATTATCGGTCGCTATTCTTATACTCTTCAATTTTCCACCAACTTTGAA
ACAGACATTAAATAACAAAAAGGGCTATTTGTAATGGATTGGCGAAGGAAGTTTA
GCTACGAAAATAACGACAATGTATTTATGATTAGCTAGTTAGCGATGGATGATATTA
GCGACGGTTGCGACAAATTATATTGGTGATGGATGTTTTTCGAATGATGACCACCGT
GTTAGCGAAGAATTTTAGGGTCTGTTTGGTAACATACAATCATGAAAGAATGTAATA
GACAACGTAAAATGGAATGAAATGTAATAGAATAAATTATTACATTTAATTGACAT
GTTGATTGACTCGAATAAATGAAATGAGTCATTCGAACATATTATTTGTTATTAATA
TATAAAAAATAAAGTAAGGTAAATTTGATAATAAATTAATTCAAGTAATTTTATAAA
ATAAATTCTATTATATGAAGATATAACATACTTTATTTCGTTATATATATATATATAT
ATATATATATATATATANNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNN
TATATATATATATATATATATATATATAGTAAATTAGACGAATGGTCACTGTG
GTTTGGGATAAATTTGTGCGCTTGATCCTTAACTGTTTTTTTAACTCGGACGGTCCCAG
AGTTGATGTGGGATGCTCGTGTCGTTTTACAAACCCTAGTCGATGCAAAGCTTCATG
GCGACTTTGATGATATGTCATTTTGGTTCCTGAGTT

SEQ ID No: 65
>Chicory_ci_vitessa_fr_v1_EVM158591
NNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNN
```

| SEQUENCES |
|---|
| NNNNNNNNNNNNNNNNNNNNNNNNNNNNNNNNNNNNNNNNNNNNNNNN |
| NNNNNNNNNNNNNNNNNNNNNNNNNNNNNNNNNNNNNNNNNNNNNNNN |
| NNNNNNNNNNNNNNNNNNNNNNNNNNNNNNNNNNNNNNNNNNNNNNNN |
| NNNNNNNNNNNNNNNNNNNNNNNNNNNNNNNNNNNNNNNNNNNNNNNN |
| NNNNNNNNNNNNNNNNNNNNNNNNNNNNNNNNNNNNNNNNNNNNNNNN |
| NNNNNNNNNNNNNNNNNNNNNNNNNNNNNNNNNNNNNNNNNNNNNNNN |
| NNNNNNNNNNNNNNNNNNNNNNNNNNNNNNNNNNNNNNNNNNNNNNNN |
| NNNNNNNNNNNNNNNNNNNNNNNNNNNNNNNNNNNNNNNNNNNNNNNN |
| NNNNNNNNNNNNNNNNNNNNNNNNNNNNNNNNNNNNNNNNNNNNNNNN |
| NNNNNNNNNNNNNNNNNNNNNNNNNNNNNNNNNNNNNNNNNNNNNNNN |
| NNNNNNNNNNNNNNNNNNNNNNNNNNNNNNNNNNNNNNNNNNNNNNNN |
| NNNNNNNNNNNNNNNNNNNNNNNNNNNNNNNNNNNNNNNNNNNNNNNN |
| NNNNNNNNNNNNNNNNNNNNNNNNNNNNNNNNNNNNNNNNNNNNNNNN |
| NNNNNNNNNNNNNNNNNNNNNNNNNNNNNNNNNNNNNNNNNNNNNNNN |
| NNNNNNNNNNNNNNNNNNNNNNNNNNNATATATATATATATAAACTAGTTATCTACAGGG |
| GCAGAAATTAAAATTGTACTGCAGTAATAGCACCATATATTATTTTCCTGTATGTTA |
| GGGGCTTTGTGAGATTGTACCATTGGAATAAGCTAATTTTTTCAAGATGTGTGGTA |
| TATTGTTATTTTTGTAGCAGCACCCGTAGTATAAAAAAAAATCCATAAATTTTGCCA |
| ATTTTCGAAGAAATTTGACCAGTGACGAGGCCACCATGTGCCCTATAGCAATTCAG |
| CCCCTAGTTATCTATGTAAGGCCATTGGGAGTGGGTATCCACGGAGGGACCGTGATGG |
| CCACATCACTACCCCATCACGGCGTGCACACCGCCCGGGTGCTCCGTGGTGGGCGT |
| GATCGTGATAGGAAGTGATGGAGATCACGGCTCATCACACCCAATAGGGTTTTTCC |
| CCCTTTTTTTCTTTTTTTTTAATTCTCACTCAACCAATTAGAAGCTTGGATTTTTAT |
| TTTTATGGAATTATTTTTATTTGAAAAAGATGATGTGGTGTGATGGGTATAAAGTGT |
| GTGTTGTGATGGAGTGTGATGGAGTGTGATAGGGGTAAAATCCTATGTGGCGATGA |
| CGTGGCGCCCATCACATTTGTGCAATGTGATGGATACTCCCACTAGCTTAAAAACGG |
| AAATACGAAAATAGTCAACTTTCCGGCTTCAAGTATATAATTATAATATTATATAAT |
| AAAATGCAAACTCGTTCAAACAGAGCTATGCGCTGCATCGCCTTTCAAGTTCAACTA |
| CTGCGCACCCTGTGTTTTATATATATACACTCGTGCGCTCTTTCTATACCTGGCAAC |
| CTTCTCTCATTGCACTTCATTACCCATATACTTTAAGATACTCACTGAACATAAATTC |
| TTTCCCGGATACTATGGATCCCATGTCCATCTTACTTTACGTTGTACTCCCTCTGTTTA |
| CCTTCTTCCTTCTCTCCCGTTTACGCGGAAACCTCTTCCTCCAGGTCCAAGAGGGTG |
| GCCAGTGATCGGGAATATGTTAATGATGGACCAACTCACCCACCGTGGCCTAGCTCG |
| GTTAGGTGAAAATACGGTGGTCTTCTTCACCTCAAAATGGGTTTCAGCCACACGGT |
| CGCTGTCTCGTCGCCGGAAATAGCCAGGCAAGTACTCCAAGTGCAAGACAACATCT |
| TCGCCAACCGTCCGGCAACCATAGCCATCAGTTATCTGACCTACGACCGCCAAGACA |
| TGGCGTTCGCCAACTACGGTCCCTTCTGGCGGCAGATGCGTAAGCTCTGCGTCATGA |
| AGCTGTTCAGCCGAAAACGAGCGGAGTCATGGGACTCCGTCAGAGACGAAGTTATC |
| TCCATGATCAAAATCACCGCTGCAAGTTCCGGTTCCGCTGTCAACCTCGGCGAGCTG |
| GTGTTTGGGTTAACCCATGACATCATTTACCGGGCAGCTTTCGGTTCTATATCTCATG |
| AAGGAAAAGAAGAATTCATAAGAATTCTACAAGAATACACAAAGCTTTTTGGTGCC |
| TTCAACTTAGCCGATTTTATCCCATGGCTAGGATTTATCGACCCTGCTGGACTGAAC |
| ACCCGATTACCCAAGGCCCGAGCAGCGTTAGATGGGTTCATCGATAAAATCATTGAT |
| GAGCACCTGAGCAAGGAGAAGAAAACCGGCGACGAAGAAGATAATGATATGGTGG |
| ATGAGATGTTGGCGTTTTACAGTGAAGAAGGAAAAGTGAACGAAGGCGAGGATTTG |
| CAAAACGCAATTAGACTCACACGAAATAATATCAAAGCAATTATCATGGTAAGTAA |
| TTTGTTGTTTAATATAATATATTTAAAAACTAAACAAGATAGATTTTCAGAAAAACA |
| TAGATCTTCAATAACATTTCTAGAAAAGGCATAAAATAATTTTCTATTGGTTTAGGT |
| AATTATCCTCTTCCATTTAAGTCGTTATCCAATTCAATGATCAGTATGAAAACATGA |
| AATTCGATATGATTTTCAACAAAAGAATTGTGTTAGGTGAAATGGCAAAACATGAC |
| AATATTGATCAAGTCACACTGGGATATGGATAGCTTAATACTTTAATTTGACTAATT |
| GATTGATTACATATGATTACTTTCAACACACTAATACATTATGATTTTTTATTATTAG |
| TTCAGGAAAACATGAATCTTTGTTTAATATATCTTTAACTATTAATCTAGTATTGCTA |
| TAAAATCATTATCTATAGGATGTGATGTTTGGTGGCACGGAAACTGTTGCTTCTGCT |
| ATCGAATGGGCTTTGACGGAGCTCATGCATACCCCAGAATCCCTCAAGCGTGCACA |
| ACAAGAACTTGCTGATGTTGTTGGCCTTGATCGTCGTGTAGAAGAGTCCGATTTTGA |
| GAAGCTAACTTACTTCAGATGTGTCATCAAAGAAACTCTCCGTCTACACCCTCCGAT |
| CCCTGTCCTATTGCACCAATCATCTGAAGCCACGGAAGTTGCTGGCTACCACATACC |
| TAAAGGGACACGTGTCATGGTTAATGCATTCGCCATTAATCGTGACAAGAACTCTTG |
| GAAGGATCCACACATGTTCAACCCATCACGATTCTTACAAGATGGGCCCCCGACTT |
| TAAAGGAAGCAACTATGAGTTCCTTCCTTTTGGATCTGGACGTAGATCATGTCCTGG |
| AATGCAACTTGGATTGTATGCAATGGAGATGGCGGTGGCTCACCTTCTTCATTCTTTC |
| ACGTGGCAGTTGCCCGATGGAATGAAACCAAGCGAGATCGACATGAGTGATGTGTT |
| TGGACTCACTGCACCAAAAGCGATCCGACTTGTTGCTGTGCCAACTCCTCGTCTGTT |
| GTGCCCGCTGTATTGATCAGAAAGGGCCGGGTTTGAGATTGTGAGAATTTGTTAATG |
| TTGCATTGAAACAAATTGTTCTTTTTCTTCTTTCGGTCATTTCCCATAAAGATAGATA |
| TAAACAAGATCAATAACCGTAAAGACTTTTATTGTCATGTACATGTTGAAAGTAAAA |
| TTTCTTGTGTTTCTTGTGTTCATATTATGTTTTCTTGTTCAGAGAATTTTACGCCAGCT |
| TTGGGTTGAATTGCTGAAAAAGACATTAAGTTCGACTCTATTAATATTCAAGTTGAA |
| ATTAGTTGTCCTTTTGTCAAGTTAAAAATGTCAAATATTTGTAGGTTGCTCAACTACA |
| ACTGATATGAAATGATACCCGATGAATGACGGGGCTTCTTCCAAGTGGGACCTTGGC |
| GTCCTACAATTTCCGATATATCTATTGTTCACAATAATGATATATTAAATAAAGATAT |
| ATTACAAAAATAACAACAAATATATATTATGTCTCCCTTTCACTTGCATATAGATAA |
| CCATGATATATAAAACAAAATGTTATATTTTTATTACAAAAATAACAAGAAATATA |
| TATTATGTTCTTATTATAAAATAACATTTACCAAATGATATTCATTGTTTACAAGGT |
| CAGATCCCATATATAGTATTTATATTGGGGATTGAAAGAAACTCACGCTTCCCATTT |
| CTTGTATGTCTTTTTGGAACCATATCTAATTCCTTTGCTCTCTTTCCCACCATCATCAC |

| SEQUENCES |
|---|
| TCACTTTACGTTATCTGTCATGGTTCTCCTTCACCAAGCCCTGGATTTCAGGTTTCTT
GGTCCAACCATAATTTCATGATTATCTTGGTCTAAAATTCGCTCTGCTCCTACCACTC
TCTAACCCTAAAGTCAAGCATCCACACCACTACTCAACTACACCGTCACCATCATCA
TCCATTCATTGCCTTTAACCACCTACCGCCAGGCGCCAGTGGTGCCAATATTTGAAA
AAGATGGTGCTTCTGCCCTTCATCTTCTCCTGGTCTTTGCCACTCAAATCTTTATCTAT
TCCATGCAAACAAAAAATCTGATCGATCGGGGCTTTCGTTTTTTAAATCGTGTTTGGT
TATTTAGATTAGGTTTTTGTGGGGTTTGCACAATATATCGCAGAACAAAGAGAAAGG
CGTGGTGTATGGACCTCTGACTTTCTGTGAATGCATTCCTTCAAACTTTGACCAAGCT
TTTCATATTTAGCTATCATGCAGTCTTCCTAGACCATGCTTGTTTGCTGCTGCATTTCT
TCAAAAATATACAACTCAAGCTTAGAATTTTTTGTGGTTGTTCATATTTGTTTTTCAA
CAATTACAACCACAAATTTCCTTTGATTCACACATGAAGATTGCCCTATAAAAGGGA
GTAGAAATCAGCACATCAAACCACACCAACAAAACAAAAATCTCACATCTTCTCTT
GTAAATACATAAGAGTTTTTAAACTCTTAGTATTTTATTCTTCAAACATTTTGTAAA
CACCACAAAATATATTGAATTGTTTCTCGGCTTCCTTCGCCCGTGGTTTTTCCCGATT
TGGGTTTTCCATGTAAATCCTCGTGTCTCTATTTTATTTACTTTATTTGTATTTTTGTT
GTGATTATAACCGTTTGATAATTTTGATCCCATTCCGCATTGAGCTAATATTGTCTAA
AGTCAATTCGGATCCGTCGTATTTTACAACAATTGGTATCATAGCGTCCGGGTTTTG
ATATTAACTTGTTGGGATCATTTTATCAAGTAATAAATCATGTCTTCGGTGAAATAC
GATATTCCGCTGCTGGATCGGAATACCCAATTTCCGCTGTGGCAAGTAAAGATGAGA
GATATTCTCATTCAGATGGATTTACACAAGGCGCTCTTGGGCTTCGAAAGGATGCCC
AATACATGGACCGAAGAAGAAAATGAGATGAAAGATCTGAAGGCTTTATCTCAAAT
TCGTTTGCACTTGTCAAACGATGTTTTACAAGATGTTCTAAAAGAAACATCGGCGGC
T

SEQ ID No: 68
>Celery_RZ_draft_99.605_EVM363634
GAGAATGATTTAAGGTTGGGTTGCTGTGATTGTTGCTTGTGGTGGGTCTGC
TGGCTGTGTGTTTGTGTTTGTGTTTGCAGGCTGCGGCTGTGTTTATGTATATAGGT
TTGAGAGAGACTGTGTTTGTCAAGAATTAGTTAAACAAAAAACGCTACCAACCGCT
GAAAATTTCCGCGGTCCGTGCGGAGGGTATTTTGGTAATTACCACGGACCGCTGAAA
ATTTCCGTGGTCCCTTTGCTGCTGTTTTAATTACCAACCGTTAGATCCACCATCCAAC
GGTGGAGAAACTGTTTGTTGTATACCGGTCTACAACAAATGTTTGTTGTAGACCGGC
CCCCATATATATAAAGTCGGTATAGTGGAGAGAAGTAGTGGATGTAGTTATTTTAAA
AATTATAAAACTTTACTATTTTTGGAAATTTTTGAAATGTAAATAATTGGAAGGGG
TATGAAAAAAAGTGTAAACAAATGAGAGGTAAGAAGGGTAGCAAGTCAAAATTT
AAAATTATTTTAATAAACATACTAAGAACTTCCTAAACACTACTGAACTCGAAAAAT
ATCCGGTCCGAGTGACCAGTGTACTTGAATTAGGTAAGTTGTTGGCAATGTTTTATT
ACTCTAAACATGATTATGATTGATCCAAGTTGGCCGTGATGCAAAATTAGACGTGTC
AGCCCCGCTACCATACTTAGTCATGGATGACACCAAAATGTATTACAATTTAAAGTC
CGTTGCAAACAAGTTAGCTAGACTAGACTTGTTTTGTTCTGATTTCCAGGCCGGCTCT
TGTCAATTTGTGCCCCAAGAGGCAATAGCATCTTCATCATACAAAATTACTATTTTTAC
ATTACACTTTTTCGAGATGTTTAAAAATTTGGAGGCCCTAGACCATCACCTTACTCGC
CGCCCTGCTGATTCCATAGTAGTATCTGTTGCTTGCCTGATTATTAAAGATTTAAAA
TAAAAAGTTGTTATAATAAATTGTATATTTAAGGAATCTGTAGGCTATCGCATTTGT
AGATTCATTAAAATTCAGTAGGAACATCAAACCTGTCTCTTTCTTTCTTAATCCACTT
ACAGACCTCTAATCCCATGTCACTTCTCTTCATTTTGCTCCTAACAATTATCTCAATG
ATATTTTTCATATCACGTTTTGGGGGTAAACCTTATCCACCAGGGCCGAGACGCTTG
CCAGTGATTGGCAATACGCTGATGATGGCCTGTCTAACTCACCGTGGGCTCGCCAAA
CTTGCGAGCCGTTATGGTGGTCTATTTTACCTCCGCATGGGTGCCCAAGACATTGTA
GTCGTGTCGACGCCTGATATGGCACGTCAAATTCTTCAAACTCATCAAGACCAAATC
TCCAACCGCCCTACTAGTATTGCTCTGGACTACCTTTCTATATGGCAGGGCCAACATG
GCCTTTGCTGACTACAGCCCTTGGTGGCGTCAAATGCGCAAAATTTGTGTCATGAAG
CTCTTTAGCCGTGCACGGGTTGAGTCCTGGAACTCTGTCCGTGACGAGTTAAACCAT
ATGCTCCGAGATGTTGCATCAAATGCTAATCAAGCTATTAATCTAGGCGAATTAGTT
TTTGGGTTTACGGAGAAAATCATCTATCGGGCTGCGTTCGGATCAAGGTTGAGCGAC
GGGGGCACTGAATTTATAAAAATAATGCAGGAATTTTCCAAATTATTTGGTTCTTTC
AATGTATGTGATTTCGTTCCATGGATGAGTAGGGCTGATCCTCAAGGGCTTAAAGCT
AGACTTCGCAAGGCTCGTGGATCACTAGATACGTTCATCGATTCCATTATAGACCAA
CACATAATAAAAAGGAAGGGAAAAAATATAGGTGACAAGGACATGGTGGACGAGT
TACTGGCTTTTTACACTGAGGAAGGAGAAGCTAAAGCTGAATCTGATGATTTACAGG
CCACTATAAAACTCACAAAAAATAATATCAAGGGCATTATTATGGTAAGTGGACTTT
CATTATGCCATTGTTAGAAATTACAGTGTACTGACAAACCAGTCTATATCATAATAA
TTTGTTAATTTCAGGATATAATGTTTGGGGGGACAGAGACTGTAGCTGCCGCTATAG
AGTGGGCTATGTCAGAGCTATTGAAAAACCCGGAGGAGCTCAGAAAGACTCAGGAA
GAGCTTTCCAACGTAGTAGGACTTCATCGCTGTGTCGAAGAGGGAGACTTGGAGAA
ACTCACTTACCTTAAGTGTGTACTCAAAGAGACCCTACGGCTCCATCCTCCCCTCCC
GTTTCTACCCCGTGCTGCAGCCGAGGATGTATATGTTGCTGGCTACTATATTCCAGC
GGGATCCAGGGTCATAATTAACCTTTGGGCAATGGGGCACGACGGGAAGTGTTGGA
ATGATGAGCCAGAAGCATTTAAGCCCTCTAGGTTTCTTGATGTGGGAGCGCCAGACT
ACAGAAACAACAACTTTGAGTTCATACCGTTTGGGACAGGTCGCAGATCATGTCCAG
GCATGCAGCTGGGCCTTCATGCATTTGAAATGGGCTTAGCACACCTTCTTCACTGTTT
TAACTGGGAATTGCCTGATGGTATGAAGCCGAGCCAAGTTGACATGAGTGACATGT
ATGGACTCTCAGCTCCAAAGGCAACCCGGCTCATTGCTGTGCCGACTCCGCGCCTAC
TGTGTCCGATCTGTTAACAAACTTGCAAAATAATGTACTTGAATTATATATCTGAAT
AATAACAGAATCAGTTTCATTAAGCGATATGATTAAGACATTCATTGAGAATCCTGT
TAATAAATGAACCTCTAGGTAGCTGCAAAATAATGAGAATTCCTGTTATGCCTGTTT
CTAACACCTGTAACGAGATGGACCGAATGAATGCTACCAAGTTAAAAAGCTCATGC |

SEQUENCES

TATTTCGGAGTTTGGTGACTTCTGCGTTCTAATTATGCAGAAGCATTAGGATTTAGG
GGATTCTCGAAAGGAGCGAGCAGAATATCCTTAGTCAAATTGTACTTCAATTTTAAG
ATCATGTAAAGCATGCTATATTAGTAAGCTACTCTTCATAATAAAAACTGCATGGTG
CTTGTAAGATTCTATGACAAATGAAACTGGATGATGCAAATGATACAAACACATACT
AATAAAATCATAAGGTAAATCTGGTACATAAATGAAATAAGATAAAGAGAAAGGTA
GGTGTAACAAGATCAACAGCAATGATAAAAATGAATGGGCAAGTTGCCGGTTTCTT
CAATTTATGTATAGGGAAGGAACCCAACCAGTGGGTGCAGCTAGGATTATAATTCG
GGTCGAGCCGGGTTAGCTTATAAACGAGTCAAGTTCAGGTCAGCATTGCACGACAG
CTGAGGCAAACATCGTTCACTTCATATTAACTACTCTTTCCCTATACTGGCTCTATTG
ATGTTGTCAATGAGCATGTGGAAAAAAAAGTTACTCTCATATAAAGCTTTAAAACAA
TATCGCCCACCGTGGGGCTCGAACCCACGACCACAAGGTTAAGAGCCTTGCGCTCTA
CCAACTGAGCTAGACGGGCTTGTGCTTTAATTTACCAAACGTAATTTATAAAGGTAA
TTTCTTAGAAAGTTTTGTTTTCTAGTAAAGTTTAATTTTTATTATATTTTGACACCGTG
ACTCTTCTGGTACAAAGAAAACACATGAGCTAATACTGAAACTAATGCAATAAAAG
TTGCTAAGGGAAAATAGTACCCTCTTGCTTTTTTCAGCTGAAATTTATTTTGGTATAA
AGTGAGCAAATAGGGATAAATATAACAGTTTGCAAGGAAGATCACAAATAAATACA
AAAAAAAACAAAACAAAGTTGCACCCAGCAAAGTTCATGCTACTCCATTGCCTTG
TTCTTCTCTTTTATCTTGTCACGCAGAGATACTTATTACTTTGGGGGTCGGCGGTATG
GGTAGAGGATGTCATCGACACTTGCTTTTACTTGATTGCCTACTTTCCTTACATTTTT
CGCAACCCCTGCTGCTACCAGGCCTGCATTTCTTGTAAACCTGAAATGTTTGTTCAA
AATTTTTTAATCGTAAGCTGAATGTATTACATTTGGATAAGAACTGAAATAGAGGAG
AAATTTAAGAACTAAAGAACAGCACTTCAGCAGTGATTGGGTTTTACCTTTTTAAGA
ACTCGTCCCTACAGACACTGCAGGTTTATGTGTCTGAGGCTGTGGCGATCTACGAT
TATCTATATAAAACAACAGTTCGACAACAACTAATTAGAAATAAATACAAATAACA
ATGCTAAAAACGTACACCACCAACAACAAACAGAACTATTTGGAGAAGATTCAATC
CACAGGAACAATGACCATATTATATAGATACAACAGTTCGACAACTAATAATTAGA
AACAAATACATATAACAATGCTAAAAATATAAACCACCAACAAGGAACAAAACTAT
AAGGCGAAGATTCAATCTACAGGAACAGTTACAATATTAACTATGTCCGTATTCTAT
ATTAAGTCTTCACATCCCAAATTTCAAACACCTAATCTTTGAAAATTTGTTTATTTAC
AAATTTCATATTCCTTTAGGTAATATTTTATGAAACACACCACCAAGAAACAACAGC
GGCGCCATTTTCTTTCCATCAGATGTATCCCCACTTTGATCACAGCTACTAGTCGAAA
CCACAATATAGAATTTACCCGTATAC

SEQ ID No: 69
>Celery_RZ_draft_99.605_EVM348724
TTAATAATTATTAGTTATGTGTTTGGAGATTCTCTTGCTAATTTATAACTAC
CATAAACAAACAAATCATCATCTTCTCAATCAGACAAACCAAAGGTATGATGACCA
GCATGGTAATACAAATCCTCGTAATTTGAACTAATCCGCATAGATAAAGATTAGTAA
AATATTTTTAAAAATTAATGGAATATTGTGAACACTATGGACTGCGAATTTGGAAG
GGAATACGTAATAAGCAACATGCGTTCCAAATTCACAGAATGAAAAATGAGTATAT
AAAGAGGTACACACCACAAGAAACTGTAGCGGTAGCAACAAATACAAAATTAAATA
TGGAACACGATCATATTACATTGGTTCAAAGTATACTACGATCTCCTACTGCCAAAA
TGACAACCATCTTCTTCTTTCTTCTATTACTGTGTTTGTTCCTTGCCCGTCGTAAACCA
TACCCTCCGGGACCGAAAGGGTGGCCTATCATCGGCAACATGTTAATCATGGACAA
GTTAACTCATCGCGGGCTCGCGAAAATCGCAACTCAGTACGGTGGTATTGTCCATCT
TCGTATGGGCTTCCTCCACATGGTCACCGTATCCACTCCCGATATGGTCCGAGAAGT
ACTTCAAATTCAAGACACCGTTTTTGCTAATCGTCCTGCAACGATGAATATTAGCTA
TCTTACTTATAATCGTGCTGATATGGCATTCGCAAATTATGGGCCTTTTTGGCGTCAA
ATGCGAAAAATATCTATTATCAAGTTATTTAGTCGTAAACGGCAGAGTCATGGGAC
TCGGTCCGTGACCAGGTTGATGACATGCTCGGAAAGGTGGTGTCTAATTCAGGCTTG
TCTGTTAATATTGGGGAACTGGTGTTTGGGCTCACTAGGAACATCATTTACCGGGCG
GCTTTCGGATCAATATCAGGCCAGGGTCAAGATGAATTCATCAAGATCATGCAGGA
GTTTTCGAAATTGTTTGGTGCTTTTAATATATGTGATTTTGTTCCTGGGATAACCTGG
CTTGATCCACAAGGGTTTAAGGTTCGGCTTGTCAAGGCTCGAGAGTCGCTTGATAAG
TTTATAGACTCGATTCTAGACGAACACATAGCTAACCAGAAGAGCAATCTAAACGG
TTCAACTGACGAGGGCAATGGTGATATGGTGTACCAATTATTGGCTTTTTACAGTGA
AGAGCAATCTAAAGTCAACCATTCTGATGATACGAACAACGCCTAAAGCTCACAA
GAGATAATATCAAAGCCATTATCATGGTCAGTGCAACCTTGACGCATCTATTAGCAT
GCATATCTATTTTCATATATATGTTAATATGTTAAAAGATGCACACATACAAAGTCT
GCTCAAGTACCAGTTTTCCTTTATAACATGATGTAAAGGATAGAGCTGAAAAGAGTA
TATTTCTAGAGTAATGTGTAGCAATTGCGTTCACTATTGGTTATGCACATATCCAAAC
ATGGTCCCTCTAGACAACAATTAGATGTTTTCCTCATGGTTTAATTACATGTTCAGGA
TGTAATGTTTGGAGGGACTGAGACAGTTGCGTCTGCAATTGAGTGGGCAATGTCCGA
GCTCATGGGAAGCCCTGAAGACCTAAAAAGGGTTCAACAAGAGCTCATAGATGTTG
TTGGGCTACATCGTCGTGTAGAAGAAAATGATTTTGACAAGCTTATTTACTTGAAAT
GTTGTATCAAAGAGACTCTCAGGCTCCACCCGCCCATTCCATTACTCCTTCATGAGA
CGGCCCAGGAAGCGGTGGTTGCTGGATATCACATTCCAGCAAAGTCACGGGTCATG
ATCAACTCATGGGCAGTTAACCGAGACCCAAACTCGTGGGATGACCCAGAAAAGTT
TAAGCCATCAAGATTTTTGAAACAAGGTATGCCTGACTTTAAGGGGAGCAACTTTGA
GTTCATACCATTTGGGTCAGGTCGAAGGTCCTGCCCCGGGATGCAACTAGGACTATA
TGCATTTGAGATGGCTGTGGCTCATCTTCTGCATAGTTTCAACTGGGAGTTGCCTGAT
GGTATGAAACCAAGTGAATTGGATACTAATGATGTGTTTGGACTCACTGCTCCTAGG
GCCACTCGGCTCGTTGCTGTACCAACTCCACGCTTGTTGTGTTCCATCGTTGATACA
TATCTATCTATCGAGAGAGCTGAGAGAAATTCTATAAATATAGTTCCAACAAATAT
GTGTTAAATTTCCTGACAAAATAAAAAGAAATGATTGTTAAATTTGGAAATATTGTT
TTAAAATGTGTAATGTTGGCTAGCCATAAGTGATTTTAATGAAATTTTACATGTTCA
ATCTCTGGTTTTAGCTATAGCGGAAATTCATGTATATGTGCGATTCTCTTCTTTTATA

SEQUENCES

```
GTGGAGTCGTGTAATAATTATTACATAAACTTTTATTATGATATATTTCTCCAACTCT
GTATGTTATGCTTTCTGAATGTATGTGAGTTACTATAAAGTTTGAGTAAGACAATGC
TTAAATCTTTTCGTCAATGGTATTGATTACCTCCCTTGTGAACAAAATTATATGGCTC
ATTCAAACCTTCATCTCATTCCAGTTCTCACTCGGGGCGGTCAGAATCACTGAGAAT
TAATCAACCTCACAACATCATGCAAGTTCAGCAAGTTGCAGGATTAGGAAGTAATG
CTTCTAATTATTAGGTAATTTCAGCTGTAGTAAGGGTAGCTTGGTACCTTCATAAAC
GTATAATGTTGGCTAGCTACAAGTGGTTTTGAATAACAAGTTATATGTGAATTATCT
GGATTCAGATATAGCTTTATGAATGGTATGAACTTCCCTGTATTTGCCATTCTCTTTT
TTCTGGCGGTAATAAGCTATATCTGTTTTGCTTTCTGACTGTTTGTGAGTGGGTAATA
ACTCTCAAATCCGTTTCCAAAACTTGTCATGAATGACGCGTGACATTTGTAACATTTT
AATTTGTGGGCGCACATGGAGTCCATCTCTTGTTATTAACAAAAAAGTTACCAAGTA
TTTGCATAAACTGTTGTATCTTAAAATTGATTGAAGTTTGGCGCTACCAAGACCCTTG
CTTTGACCATTCCTGTAAATTTTTATGTAACACTTTGGAGTGAAAAAAAATGAAAT
AAATGCCCGGAGAAACAAATATTTGATCCTCACAAGCTTCTTCCTGGTAATATATTG
GTTAACAAACGGTGAGAACCTTTTCCTAAGCATAGTTCATTACCTCTCGGATTGACA
ACTAACATTTTCGCTGATTTCGGTCTCTTAACGTTGATGCAGACACACTAACCTTCTG
AATACTTAGTAATAACACCAGATGAAGGATAAAAATTAGATATTAGCAACTACTCA
GAAGAGAGATAAGAGTTAACATACACAAAAGTTTCTTGGTGCATGCTTTCACGATCA
AACTCGTTGGTGAGGTCCAAAGCTTTTCGGCCCGATTCACTAATTAATCACAAGCTC
TCTAGAATCTAGAAACTCCCATTGCCTACTACTACAAAGTTATAACAAGCAATAGTC
AACAGACATGACAAGAAATTTCTTGATTGAAATTTCAAGTTTGAACCTTCAACAAAC
TATACAAGAGATAGTCTGCACGCCATGTAACTTACTGGATCTCTTGACACTTCTAA
GCGTCACAAACTCAAGATTTTTATTTTAATATTGCTTTCTTGAATTTTCTTCTTAACAT
GCTGGGACATGCTCAGTTTCAACCTTCAACAAGCTTATTTATAGCTTTCAACGTCTAA
CAAGTAACATTATGAATATAATATCATATCAATTCCATAATAACCTCATGTGTATTT
ATCATATTACAGGGCTGACACAACAAAAAATTTCGACAAGGTTAATGTCATATTCC
CACAGTTTACCAGTTAACCTCTACAGAGGTGCTTTGCCGATGATACTGAAAGGAGA
AGAAGCTTAAATGTGCCTTAAACTTGTAAAAGCCTTCTTCTCCTTTTCAGTATCATCT
GCAAAGAATCTCTATCGAGGTTAACTGGTGATTCACATTGAAAATTTTATCTACAGA
TGTGACCGATGATGAAATCTGCATATGTGTTCGATAAAATCATCAAATTCTCTATGA
GTATCACCTCCTTCCGCCACTGATCTTTTGACAGCAGTCCCCAACTC
```

SEQ ID No: 70
>Celery_c17480_g1_i1|m.26831
```
ATGGAAACCAACACTACCGCCATGACAATTCTCTTCTTCATTCTTCCGCTG
CTTAGTTTCTTTCTCTTGTCCAGCTTTCGACGTAAACGTTACCCTCCAGGCCCGAAAG
GTTGGCCCATCATCGGCAACTTGTTGATGATGGACAAGCTATCTCATCGTGGACTGG
CTAAACTTGCTGCTCAATATGGCGGCCTTGTCCACCTCCGTATGGGTTTTCTTCACAT
GTTCACCGTTTCGACTCCCGATATGGCCCGAGAAGTTCTTCAAATTCAAGACAACAT
TTTTGCCAACCGTCCTGCTACCATGAATATTAGCTACTTAACTTATGACCGAGCGGA
TATGGCTTTCGCAAATTACGGGCCGTTTTGGCGCCAAATGCGGAAAATATCGGTCAT
GAAGTTATTAGCCGTAAAAGGGCAGAGTCGTGGGACTCTGTCCGTGAAGAGGTTG
ATGACATGGTGAAAATCGTGTTGTCGAAGACGGGGTGTTCGGTTAATATTGGAGAG
CTTGTGTTCGGGTTAACTAGGAACATTATTTATCGGGCAGCTTTCGGGACGTTGTCG
CACGAAGGCCAAGACGAGTTTATCAAGATATTGCAGGAGTTTTCGAAACTGTTTGGT
GCATTCAATATCTGTGATTTTGTTCCGGGATTAACTTGGGCAGATCCGCAAGGGTTC
ATGGGTCGGGTGGTTAAAGCTAGAGCATCGCTTGATGGATTCATAGACTCAATAATA
GATGCACACATTGAAAAAAGAAGAGCAGTAAAAATGGTATTATCGACGAGGGAA
ACAGTGATATGGTGTATGAATTGCTGGATTTTTACGGTGAAGAAAAGGCTAAAGTCA
GCGAGTTTGAAGATCAGAACAGCTCCTTGAAGCTCACAAGAGATAACATCAAAGCC
ATTATCATGGATGTAATGTTTGGTGGGACGGAGACGGTAGCATCTGCAATAGAGTG
GGCCATGTCAGAGCTAATGAGGAGCCCAAAAGACCTCAAAAAAGTCCAACAAGAA
CTCGTCAATGTTGTTGGGCTTCACCGTCGTGTTGAAGAAAGTGATTTCGACAGGCTC
ACTTACCTCAAATGCTGCATAAAAGAGACTCTTAGACTCCACCCTCCCATCCCACTA
CTTTTACACGAGACGGCCCAAGATGCGGAGGTTGCTGGATATCACATTCCGGCAAG
GTCTCGAGTCATCATAAACTCATGGGCCATCAACAGAGACCCAAACTCGTGGACTG
ACCCGGACACATTCAAGCCTTCTAGGTTTCTACAAGAGGGTATGCCTGACTTTAAAG
GAAGCAACTTTGAGTTCATACCATTTGGGTCGGGTCGGAGGTCTTGTCCAGGCATGC
AACTTGGACTTTATGCACTTGAGATAGCTGTGGCTCACCTTCTGCATTGTTTTAACTG
GGAGTTACCTGATGGTATGAAGCCAAGTGAAGTTGATACTGATGATGTGTTTGGTCT
CACTGCTCCGAGGGCGACTCGACTTGTGGCTGTGCCAACTCCACGCTTGTTGTGTCC
TATCTCCTGA
```

SEQ ID No: 71
>Brassica_Bo1g005770
```
ACAATCTGGATTCATGTGTGATTTTTTTAAAATATAGATCCAATGAACCTA
TTCCTAGAAAGTCATATTACATTTAATCTATAATCTTATCATTTAAATTTTGGATCTA
CCAGAAACTTTTATTGGACTATCAATAGTTAGATTTAAACAGTGGATGATCTATTGG
ATTTATAGATAATATAATTAAATAGATATAATTTAATGTTGTAATATTATACCTCTAT
ATGTTAAATACTTAAATATTTGTCTATGTTATTTTTAAAATTATAAAAATCTTTTTTT
TAAATAATAAAAATCATATTATCTAACAATGATTAATCTTTACTACCTTAAACCAAT
GAAAACAAATTTTAAACTATATAGTTTATTTTAAAAATTAAACAAAAACTAAATGTT
TAATTATTTACTCGATAATATAAATCTATGAAGAGAAAGTTTAATTTCTTAATAAC
TTTCTAAATTTGTGAAATGTTACAATATCTTTGAATATGACAATACAATAATATTTTA
CTAATCTTTATATATATAGTTACGATTTTAATAATGAAATAATAATCCGAAAATATA
TATATATAAGAAGATTCAAATACATGTGAAAGTTTGAAACAATCTATTCAATGAAAA
AAAAATACTGTAAACTTATTATGTTTTAAAAATTGATAGACACATATATATTATAAT
```

```
                                  SEQUENCES
ATATATCAATTTAGAATTGAAAACAAAATATTTATATAAAAATAAATGAAAACAAA
AACCCGCGCGGTTTAGCGGATCGAGATCTAATCTTATATATTAAAACAGAAGTCAAA
ACATTGATTCATGTGCGATTTTTTAAAAAATGGACACTCAATAGAAATCAATTATCA
TTCATTTATTACTAATAATATGGATTAATAATATATCATTCCTAATATAACATCGACT
CCTAAAAATTCGGATTGGTTAACAAACTCACCTTGATTCATGTGTGATATTTTAATTT
GGATCATCATTTAAATTTTTTATTAAATGTATTTACTTAATGTTAATATATAATCTTTT
AACTACTTAAATCATGATATAATTTGATATCTTTTAATTTAAAATATAAATATATATA
TTTATTTTTTTTAACAAAATGTGTTGAAAAACATTATAACAATATCTTAATTATCAAA
AATTGTATATAAATATTTTTACTAATTTTGTAATTAGTAATGAAATTAATGTTATTAT
ACATTAATATATATACTCAGTTATCTTTTATAAACATTATATTTAACTATTTTTACTAT
TTTATAGTTATATCTAACATTTTAAAATAAAATATTGTATTTAACTAAATATGATAAA
ATTATTTTAAACTGATAAATTAATATATTTTATTTTCACAAACATTAAAAAATTTATG
CTAGAAATATAATATGTTGGTAGAACGGGTTAACATTAGTAAATTAGATAATTCATG
TATAAAATTAACTTATCTTAAATTTTTATATATTTATAGTTATTATCTTAAATGAATA
AACATAAAAAATATTGATAAAAGAAATCTAGCGCTTTGAATTACGGATCATGATCAT
AATAATTGAATAAAAATAATTTTAAAATATATATAATAAAAAATACCAAATATATGT
GATGATTTGAAATAATCAACTAACTTACAGCATAAAAACTATCAAATTTTTATATTT
AAAATAATTATATATAAACATTTAAATATATATGTAAGTAACTTAAAAAATATATTC
TAATTATGTAATATATATATAAACATGAAAATTAATACCCGCATAGTTGTGCGGATC
CAAATCTAGTAATAATTAAAAAGAGGTGTATGTATACATATATATGTGTCACGAAAA
TGAAGTTCCCATATAAAATTAGAAATATGCAATAAGTGGGACCACACTTTGATTATA
AAACCAACCTTTCGTAACACATCCCAAATGGCGAACTTTGCCTGATCAATTCCTGA
GACCTTCCACAAACAATAGAAAAAACATTTCCCAGAAAAAGAAAAACTAATATGG
AGTCTTCTATATCACAAACACTAAGCCAAGTATTAGATCCCACCACGGGTATTCTCA
TCGTTGTCTCACTTTTCATCTTCATCGGCCTCATCACACGGGGACGAAGGCCTCCGTA
CCCACCCGGTCCACGTGGTTGGCCCATCATAGGCAATATGTCAATGATGGACCAACT
CACTCACCGTGGTTTAGCCAACTTAGCTAAAAAGTACGGTGGCTTGTGCCATCTCCG
CATGGGATTTCTCCACATGTACGCCGTTTCCTCGCCAGACGTGGCTAGGCAAGTCCT
TCAAGTCCAGGACAGCGTCTTCTCAAACCGACCAGCAACTATAGCTATAAGCTATTT
GACTTATGACCGAGCCGACATGGCGTTTGCTCACTACGGACCGTTTTGGAGACAGAT
GAGGAAAGTTTGTGTCATGAAGGTGTTTAGCCGTAAACGAGCCGAGTCATGGGCTTC
TGTTCGTGATGAAGTGGACAGAATGATCCGGTCGGTTTCTAGTAACGTTGGTAAGTT
CGTCACTCTCTATGTGCGGTTAAATATTTTAAAAGTGAACAATCATTTTTGTTAGTTT
ATTATGCATTTGTTTTCGTGTATATATGTGTATTTTAATAGTCAACCAAAAATATCGT
AGGTAAGTCTATCAACGTTGGTGAGCAAATTTTTGCACTGACCCGAAACATAACTTA
CCGGGCAGCGTTCGGGTCAGCATGTGAAAAGGGACAAGACGAGTTCATAAGAATTT
TACAAGAGTTCTCTAAGCTTTTTGGAGCCTTCAACGTAGCGGATTTCATACCGTATTT
CGGGTGGATCGATCCTCAGGGAATAAACAAGCGGCTCGTGAAGGCCCGTAATGACC
TAGACGGATTTATTGACGATATCATCGATGAACACATAAAGAAGAAAGAGAATCAA
AACAGTATTGATGCTGGAGATGTTGTTGATACCGATATGGTTGATGATCTTCTTGCTT
TTTACAGTGAAGAGGCGAAATTAGTGAGCGAGACAGCGGATCTTCAGAACTCCATC
AAACTTACCCGTGACAATATCAAAGCAATCATCATGGTAAATATTTTTCACGAGGCA
CTAGTAACAGTCATTATTCTTAATGCGTTACGTCATAAAACTCATCTATTAAACCGGT
TGTTTTCTCTGCACGTATATATTTTCTGTTTTTACAAGTAGTCTAATATAATATTAGA
GAACTTGCGTATGCAGTCGTTTTATTGATAGTAGAAAAATACAAAGGTTTTACGTAT
ATCACACGTAAATAAAATCACCGTATTGGAAAACATACTATAAGAACATGATTATA
GAGAGGTTCTTGGGGTGAAGTTTTTAGCGGAATATAAGACCATGATTATCCCTAAGG
GTTTCTTAACAATTTTTTTTTACACATCTTTTATCTAAATAAAAAAAAAAATTAAAA
AACATACCAATCGCGGGTCGTCGCGTATCGGTGGGACCCGCGAACAGTCCACCAAA
CTCATCACAATCGATCCTTATCCTGCATCTTTTGTGACCGTTTTTTAAACTTTTTGTGG
GCCCCAGGGCTAAGAAACACTTACAAAACTACCGATATTTATGCTCTAAGAATCCGT
CTCTTAACTTTTAACTAAAAAAATTATAAAAAAATTAAGAACTAGTTCTTAAATAAG
AGTTTTAAGAGACGGTTTTTATCGTTTTTGATTAAAAATTAATAGATGAGTTTCTTAT
ATTTCGCTAAGAACTCCACCCTAAGAATCTCCAGGTAATCATGCTCTAACGTCATGT
GAATTGACTTATTTTACTTTTTCGATAGGACGTTATGTTTGGAGGAACGGAAACGGT
AGCGTCAGCGATAGAGTGGGCATTGACTGAGTTATTACGGAGCCCAGAGGATCTAA
AACGAGTCCAACAAGAACTCGCTGAAGTTGTCGGACTTGACCGACGTGTGGAAGAA
TCAGACATCGAGAAGTTGACTTTTCTGAAATGCACACTCAAAGAAACCCTAAGGCTA
CACCCACCGATCCCACTCCTCCTCCACGAAACCGCAGAGGACACTGAGATCGACGG
TTACTTCGTTCCCAAGAAATCTCGCGTTATGATCAACGCGTTTGCGATTGGACGCGA
CAAGAACTCTTGGGTTGATCCCGAAACGTTTAGACCGTCGAGGTTTTTGGAACCGGG
CGTACCAGATTTCAAAGGGAGTAACTTCGAGTTTATACCATTCGGGTCGGGTCGTCG
GTCGTGCCCGGGTATGCAGCTCGGGTTATACGCGCTTGAACTAGCCGTGGCCCATAT
ATTACATTGCTTCACGTGGAAATTACCTGATGGCATGAAACCAAGCGAGCTTGATAT
GAGCGACGTGTTTGGTCTGACGGCTCCTAAAGCCACGCGTCTCTACGCTGTCCCGAG
CACGCGCCTTATTTGTTCTGTTTAAGTTATGGTTCGAAGCACGTGGCGGGTGAAATG
AAAGGTGGTTGGTATGGTTGATGGTTCTTGAAAGTGGTGTGAGAAGTCAAACGAAG
CCCTGAAAATTTGTTGATGTTATATAATATATGTTTATGTATTTGTTGTGTACACACG
TGTGTTCTGGATGAAACATAAAGTGGCTCTTTGTTTCGTTTTTCATCTTCTTTTGTGG
GAATTTTTTCCTTGCATGAAATGTAAACGCTGAAAAATAAGATTTTTTTTTACAACTA
ATTTGCATATTACAAAAGTATACTAATGATCCAAGGATTTTGCAAACATAAGCATTT
CCATCACTATGAGTCCAGAAAAGAGTTTGGCAACCGGTGAACTAAGTGAAAACTCA
TCAACTTTACTATTTGAGGAACCTAATGTTAGAGAAATTTGGAGGCGATAGCTTTCA
ATTTTTAGTTTTGAAAAGCCAATTATTTTCGTGTAGTTTTTTAAAAAGTCAGATCACT
TGATAGAAAAAGTTAAATTCTAAACTCTTCACGTATTTTCTTATTTAATTTTATTTTG
TTAAGGTCGCGTCTTCTCTATTGAAAAGTTTTATAGTATATCTTATATACTCATTCAT
ATGGAAAAACATTGTAGTCTTTATTGAAAACGCACCTATCATTTATGTATCATGAAT
```

SEQUENCES

GTATGTGTTGATTACTTAATTTTAACACCATCGACGATCAGATTTCTAGATGGATGG
CAAAATCCATGTTTAAACTACTCACTTAAAAAATAATGTAACAACCAGAATGCATCA
AGTACTAAACGATCCCTACTTCAACTACCTTGACGAAATCAATAAATTACAATTACT
TAGATTTTTCGTAGCTACACGTAGCACATTCATTAACATATATGTAGTACTATACGTG
GACTATCGAATATCACAAAATAATTGCAAACATATGGTTATCAGTATTAAATATGCC
CCCTGAAAAATATTCAATCATATAGAAAATCTCCGAAAGATAAGAAAATGACAAAT
TTATAGACAAGCTACAAGCTGTGAATTATGAAGCAGTCATCGCTAATATTAGCTCAA
AGCCAAACCTAACATTTAAGGCTTGAATATCTAAGCCATAGCTTTGTAAAGAAGTTT
GTTCGAGTAGGGTTTGTCATTGTCTTCTAGATAAGACACACATTTTAAATTAAAATA
AATAATATATTATAAGTAGAATTATTATAAAGTATAATATTATTTACCTCATTAAAA
CCTTTTTACTGCTGACAAATTTTTTTTTTTACTACTATTATTAATCATAATAACGCAA
TGTAAATAAAATTAATTTTAAATGTATAGAACAAGAAGTTTATATAATATATTATAA
GAATATTATTATAAACTATAATTTTATTCGACTCATAAAATTATATTTATAATTTATA
TAATTTTTTAAAAAATTACTAATATTATTAATCATAACAACACACTGTAAATAAAAT
TAATTTTAAATGTATAGAAAAATAAGTTTATATAATATTATGTCAATTTATACTACAT
AATTTTTACTTATCATATCATAAAGAACTAAATTCTAAAGTGTTAATGAAAATGAAT
AGATTGTTTACTATTTTAAAATTAACTAATGTTTTATTTACTAGCAATTCATAATATG
AATTTTAAAGACAATGGATATATCTATACGTTGTTTGGAAAAAGTAAACTTAAAGAT
GAAAATATAATGGAAAGAAATAAGGAAAGATAAAAGCCAGTTCAAACAAAAAAAA
TTAAGAAAATATAGATAAAAAAAATAAGTATGGAAAAAGGTAAAAATAATAAAAC
TAAAGCTTGTAAATTGCCACACAGAACTTAAATTAAATTCACATAAAATAATTTGTG
AGTAGATCGAACTCTCAACACTGGAGCCAGACGGGAGCACTTTTACCAACGAAGCT
ACAAAAAATTACTAGAACAACTCTAACTGACAAAAATTAAAAAGTAGTCGGAACAC
GTGCCCCCGTAGCTTACACTGTAGATCCGCTCCTGGCAGTACCACCAAAAATTGAGA
AGGCGCTTAATTTTTGACTTTTAAAGCATTTCCAACCCAACTCCAATTTTTACTCTAA
AATGAAATAAAAGTAGATATAAAACAATAATTGGCGGTGCCTCCTTGACTTCACATT
ATTTCGTGGTGGAAGGATAAGAAAATGACAAATTTATAGACAAGCTACAAGCTGTG
AATTATGAAGCAGTCATCGCTAATATTAGCTCCAAGCCAAACCTAACATTTAAGGCT
TGAAT

SEQ ID No: 72
>Brassica_Bo7g117840
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNCC
AAGGGTTTAGGGTTTAGTGATTAGGATTTAGGGTTTAGTGTTATTAAAATTTAGTTTT
TAATGTATGATTTAGGGTTTAAGATATTCCAACGGTTTAGAGTTTATCCAAAGTTTA
AGGTTTAACGTTTAGGGTTTAGGATTTAGGGTATAGGGTTTAGTATTTTGCTGAAGA
CTTAACAATATTAATTAATTTATTTTTTTGTAACTATTTTTATGTATTTTTATTATTTT
ATTTTAAAAATATAATCTAATTTGGATATTTAATTTTATTTCTTTTTTTAAAAAATATC
AAATATCAAATATTCAAACACTATTGGTTGGTTCAGAGGTGAACCCAAAAATTTGAC
CACAACTTGATTATAAAACCCACCTCTCTAATCACATCCCAAAATGGCGAACTTTGC
CTGATAGACCTCTTACAGAAAAAGAAAAAGAAAAATCATGGAGTCTTCTGTATCAC
AAACACTAAGTCAAGTATTAGATCCCACAACGGCTATTCTCATCGTCGTCTCACTTTT
CATATTCATCGGCCTCATCACACGACGGCGAAGGTCTTACCCACCCGGTCCACGTGG
TTGGCCCATCATAGGAAATATGTTAATGATGGACCAACTCACCCACCGTGGTTTAGC
CAACTTAGCTAAAAAATATGGCGGCTTGTGCCATCTCCGCATGGGCTTCCTCCATAT
GTATGCCGTCTCATCACCTGATGTGGCTCGACAAGTCCTCCAAGTCCAAGACAGCAT
CTTCTCGAACCGGCCGGCAACGATAGCTATAAGCTATTTGACTTATGACCGAGCCGA
CATGGCGTTCGCTCACTACGGACCGTTTTGGAGACAGATGAGGAAAGTGTGTGTCAT

| SEQUENCES |
|---|
| GAAGGTGTTTAGCCGTAAACGTGCGGAGTCATGGGCTTCTGTTCGAGATGAAGTGG |
| ACAAAATGATCCGGTCGGTATCTAGTAACGTTGGTAAGTTAGCTATGTGCGGTAAAA |
| TATGTAAAAAGTAAAAACAACAAACAATGTTTCTCTCTTTTATACGTATTTTAACAG |
| CCATACCAAAAAAAATGTAGGTAAGTCTATAAATGTCGGGGAGCAAATTTTCGCCCT |
| GACCCGAAACATAACTTACCGGGCAGCGTTCGGGTCAGCTTGCGAAAAGGGACAAG |
| ACGAGTTCATAAGAATCTTACAAGAGTTCTCTAAACTTTTTGGAGCCTTCAACGTAG |
| CAGATTTCATACCATATTTCGGGTGGATCGATCCACAAGGGATAAACAAGCGGCTCG |
| TGAAGGCCCGTAATGATCTAGACGGATTTATTGACGATATCATCGACGAACATATGA |
| AGAAGAAAGAGAATCAAAACACTGTTGATGATGGATATGTTGGTGATACCGATATG |
| GTTGATGATCTTCTTGCTTTTTACAGTGAAGAGGCCAAATTAGTGAGCGAGACAACG |
| GATCTTCAGAATTCTATCAAACTTACCCGTGACAATATCAAAGCAATCATCATGGTA |
| ATTTCTTTTTCAAAAGACCACTAGGCACATTCATTATTCTTAATGCGTCACACCATCG |
| AACTTATCCATCAAACCACTAGATTCATATTTTTGTCTAAATGAGGAAGGTAACTTT |
| CTGTATTTACAAGTAGTCCATATGATATTAGAGATTTTGCGTAAGCATTAGGGGAAA |
| ATGACGTCATTTACTGATGGTAAAAACTCATAAAAATATAAAGTTTTAGAAAAGACC |
| TAAAATACGAAACATGTAAAAAACACGTACAAAGGTAATATAAATCACACGTAAAT |
| ATAATCTGACCGTCTTTGAGCTAACAATTTATTTCTGTTTACATTTTAAAATCTAATT |
| TGAATTGATTTATTGAATTTAATAGGACGTCATGTTCGGAGGAACGGAAACGGTAGC |
| GTCGGCAATAGAGTGGGCCTTAACGGAGTTATTACGGAGCCCCGAGGATCTAAAAC |
| GGGTCCAACAAGAACTCGCAGAAGTTGTCGGACTTGACCGACGTGTGGAAGAATCA |
| GACATCGAGAAGTTGACTTTTCTGAAATGCACACTCAAAGAAACCCTAAGGCTACA |
| CCCACCGATCCCACTCCTCCTCCACGAAACCGCAGAGGACACTGAGATCGATGGTTA |
| CTTCGTTCCCAAGAGATCTCGCGTTATGATCAACGCGTTCGCGATTGGACGTGACCC |
| TAAATCTTGGCCTGACGCCGAAACGTTTAGACCGTCGAGGTTTTTAGAACCGGGAGT |
| AGCTGATTTTAAAGGAAGTAACTTCGAGTTTATACCATTCGGGTCGGGTCGTAGATC |
| GTGCCCGGGTATGCAACTCGGGTTATACGCGCTTGAGTTAGCCGTTGCTCATATATT |
| ACACTGCTTCACATGGAAATTACCTGATGGGATGAAACCGAGCGAGCTTGACATGA |
| ACGACGTGTTTGGTCTCACGGCTCCTAAAGCCACTCGTCTTTTCGCCGTGCCTAGCA |
| CACGCCTGATTTGTGCTGTCTAAGTTATGGTTCGTAGCACGTGGCGGGTGTAAAACC |
| AAACGAAGGGTTGGTTCTTGGAAAGAGTTTGAAAAGTCAAATGTAGCACTGAACAT |
| TTGTGGATGTTATTATATGTATGTATGTGTATCACGTGTGGTCTGGATGAAAACATA |
| AATGGCTCTTTGTTTCGATTTTCCTTTTCTTTTGTTGGGATTTTTCCTTGAATGAAATG |
| TAACTGGTCAAATATAGTTTTTTTTGTTTATCTACATTACCTTTGCATATTACGTAG |
| GTAAACTATTAAGAGTATTGCATTCGTTAGAAATTTTATAACCTACCGACAAATTTC |
| CATCACCATGAGTCTATGACTTAAAAGAGTTTGGCAACCTGTAAAACCAAGTTAAAG |
| CTCGATTTGTATTTTAAACCAGAAGTTAACCCGCGCTACGCGCATAGTTATTTTGATT |
| TTCAAATTTTAACTATATAGATATTCATTTGGACCTTGTATTCTGAACAACAACAAA |
| ATTTTGAATTGTATGTTTGAGTGAATACATATTTACTTAGAAAAACAAAAAATTAT |
| ATATATTTTTCATATAGATATTTGATAAAGTTTTTCATTTATTATATTGTATATTTACT |
| TATTATTTAGTTTTTCTTATATTGTAGGGCAATTCTATCAAATAACATTTTTAAGTTTT |
| TTCACAAAATAGCCATCAATAAAGAAAATGACCAAAATAGCCCCTTTTATTTTGAAA |
| ATTTATTTTAATTTTAATTTTTTTTAAATTTAAAACCATATCCTCAAAACTCCACCTCT |
| TAACTCTAACCCTAAGTATATATTATTTAACCTTAGGATATAAATGTATTTTTACTCT |
| TTAATAAAACTTCTTTTGGTCATTTTTCTTATTGAGAACTATTTTTGTGACAAAAATT |
| TAAAAGGGTTATCTTAGGAAATTTCTCTATATTGTATATTTATTTATTCTAATTTTCTT |
| ACTTTTATATCAAATGGTAATATTACCGAGTTAAAACTCAATTTGTATTTAAAGTTTA |
| GATATTGTTTTTTTTTTTGATAACCGAGTGTTTTGGCTCCACCGTGGTGGTCCAGA |
| CTAGAGACCGAAGCGAGCAAGGACGCTGCCAGGACGTCACCATGTGGCTCATCGTG |
| AACGGTTTTCGATCTCGGGCACTGGGGGATCCGCATGTAAATTTTCCAGTGGCTGGG |
| TTTCGAACCTAGGTGGCGGAACTCACAGCCGTGAGTCCTTTACACCAGAGCTAGATA |
| CCACGGTTAAGTTTAGATATTGTTTGGTATACGAATATGTCACTTTTCAATTTATATA |
| ACAAAATGTCTTTTGACGACAACTTTTATTAGTTTATTAGATAGTTATGTTTTTCTTT |
| TATATGAAATGTATATGTCATTATCATAATTGGTGTATTAGAAGATGGTTTCTTAAA |
| AGTAAGAAGTTCTGAAATTTGTGGTGAAACAACTGTATATAAAATAGCTGTAGAATT |
| CTTCCTTTTCTTTTGAAAGCCTATTTGTTTTCTTGGTAGGATTAGATACGTAACATGA |
| TAGTACAATAACATGCACCTACCATTTACGTATGTGTTAATAACTTAATTCAAACAC |
| CATCGATGGTGCAATTTCTAGCTGAATATCAAAACTCATATCCAAATTATTCATTTGC |
| TGAGAATGAGTTGCTCTAAAAATCCAAGCCAGGGATCAACTCCTCTCAACATAAAA |
| ATTTATTTAGCCAGTTCAAATAATGCCATATATTAAAAATTCAGTGAATCACGACTA |
| CACTCACCCTGAAAAATTATATGCGTGTTAAAAGCCCAAATCACCTTCTAGTTATAA |
| AACTATTCACTTATAAAATATTTACACATACAATAATTAGCTAGAAGTATTATAACA |
| GCCATAATGCATCCCGTAGTTATTGAATTTATCATTGCATCTACCTTGGCGAAAGCA |
| ATAAATTGCAAATCACTCAAATACGTTAGATTTGCAGTAGATATACACACGTAGCAC |
| ATTCATATTCACGTACGTATGTACCATACGTGGATTATCCAATATCACAAAATAATT |
| GCATATATTATTTTCAGTATTGAATATTCTCTCTGTTTCATAATAAGTGTCATTTTAA |
| CATTTTTTTGTTATAAAAATAGTGTCATTTTACAATTTCAAACAAATTATACTTATTT |
| TTAGTTGAAAATTAATTGAAAACTACATTGATTTTATAAATAATTTTATTATCTCAAA |
| T |

SEQ ID No: 73
>Brassica_Bo7g119430
AAATCCTAAACCATTACTCCTTTTGGTATGAAACCAATTCGCCGCGTGCTC
TGGTTGAATTGATAATCTATAGCAAGTGGTTTCACGGTCAAACTCCTCATGGTTGCA
AAGATATCCTTCTTTGAATGCACCTACGTCGCTGCTGGCTCCAATGTAGCTTGTATGG
TTGATCTCATGGAGTTGGTGGTCCAGCTACTGACTTGAGGTCCTCATCATGTCTCCAA
GGAAACCTCCAAGCTTCTTTCCTTTACAAGGATGTCACTCTTGTTACTTCCTCTATCC
AAAGGTTTGCAAGGGTTTGTTTCGTTATTGTTACTTATTATTAATTGAAACCGTCGTA

| SEQUENCES |
|---|
| ATATTCTCCTTACTTATTTCAAATCTTATGAATGGTTGATACCTAGTTACGATAAGCT |
| AGAGCCACACATGCCTCAGATTCTCAACGTTTCAGCAGTTGCTATTGAATAAGATTT |
| GAGCGGTGCGATTGCGGAAGAGATTATGAAGGCTATCAAAGAGAGGAATCAAGTGC |
| GGTTATCTCTTACAGATTGTAGAGAGGAACAGGAGAAAGGTATCATAAGCTATGAA |
| TGCCATGAAACCACATTGCGGTTTGAGCCAGGCTCTGATCAGATTAAGGCGACTGCA |
| TATGGGAAGCACCCTACTCATCATCAACCTTTAGCTTATACTAGGCTAATACATTTTG |
| TGATATTTTCGTATTATATACTACCATTCAGTTAATATATTAAAAAAATACAATACA |
| AAGACTACAAAAATATTGGTTTTCGGGTACAATGTTAGAACCTATTCCAATACGAAT |
| GTTTCTGACTATATAGAAGAATCTTTTTTCCCTTCAATATAGATGCTGAACAAATAGC |
| AGCGTCTCTTTAACGAGACAAAACTTGTGTCCAAAAATATCACAAAACCCACGACA |
| AGAAGCCACTAGAGAAGACCTCGATGACCTTAGCTTGCAGTTTCAGTAGTCTATGTA |
| TGTTCAAGAAAAAGATGTTAGTTTAAAAAAGCACGATTGGGTGTCGGAAGTTAGAA |
| ACAGGGACATATCATTGATATCAACACATTTCTGCGATTTCTTCGTAATACAAAGAA |
| CTTTGAAAACTGAAGTAAGTAATTTCTTCTTTAAACCCAGGACATATGGGCCTACAT |
| AATAGCACCAACGAGGCAACGATACAATACTCAGAAATTGCTTACTTAATTTTTTA |
| ATTCATCTTTTTAATATAATTATTTAACGGTTTTTTTACCAACGAATCATGCTTTATAC |
| TTGCATATATTTATTTGTTTATTGTGATCAAACTCAAAAACTGTACTATCACGTAGCT |
| GTCATGTAAATCTTGAGAAAGCTACATAGTTGGTCTTACAAAGCGTTACCATGCATG |
| TACTTTGTTTTTTTGAACGAACCATGCATGTTCTTTTTCGTTTGATTATTTACAAACG |
| TTCTTTTTTTGTTAGATTAGTTCCATGTAATTTTTTTCGTGCTAAAGAAATATTAGAA |
| ATTCTATTCCTCAATTCTCACGCCAAATGTGTACGGTATCTGGTTTCGTCAGAAGTAT |
| TATAAACTGACAATGCTAGCAAATGTTCTTTGACTAGAAAATTACATTTATATCATTT |
| ACAAACTAAAAAATCCAAATAAAATTTTAAATATTTGCATATAATTCTCGAACCCAT |
| AGATCTATTGATCTTTATTGTAAATCTTGAATGTAGATTTCCTATCCAAACTACATAT |
| TGTTCTTTATTAGGATATTGATTATTGGGATATTGACTATTGACTTGTTTTCTCTTTTT |
| TTCTGGTCAAATTTGACTTGTTTTTCTAAGGTAATAAATGATCTATTAAATACCCAA |
| AACGGAAATAAATCTTTCATTTATATATTGTTTATCATACACATCTGTATGTGCTAAT |
| AAATCAAATACAGATTATCAACCAGATTCGTGCGTATATAACCATACCAAAAACTT |
| CTTATCACCCATCTTTTCGCTCTTTGTATCGGAAAGAAAAAAACATAAAAGATGGAT |
| TGTTTGCTTTGCTCACCAATTTTATATGTAGTTCTTATATTTCTTTGGTATTTAGTTAG |
| AGTTTTGTTAACTCGTAGTAATCCATTTCCACCTGGTCCAAAAGGCTATCCAATAATC |
| GGTAACATGAAATTAAAGAATCAGTTGAATCATCGTGGTTTGGCCGAGTTAGCCAA |
| ACAATACGGTGGTCTCTTACACCTTCAAATGGGTAGAATTCATATTGTGGCCGCTTC |
| AACAGCTGAGATGGCCCGAGAAATTCTTCAGGTATGTGGTTTTCTACGGTTTAGAAA |
| TTGTTTTGACAATTTAAATATTCTTCTAAATATTTTGATAGGATAACAGTGAATTTAT |
| AGTTTTTGTAAGACACATTCATCTTAAAACATTCAATTACGTTAGGTTCAAGATGTG |
| GTTTTCGCAAACCGGCCAGCTAACGTCGCCATTTCATATCTCACTTACAACCGGGCA |
| GATATGGCGTTTGCGAACTACGGTCCACTCTGGCGTCAAATGAGGAAAGTTTGCGTT |
| ATGAAACTCTTTAGCAGAAAACGGGCCGAATCATGGGCCTCGGTTCGCGACGAAAT |
| TAATACGATGGTTCAAACTCTGACTAAACAAACCGGTTCACCGGTTAACGTTGGCGA |
| GCTTGTCTTTGCTTTGACGCGGAACATAACGTACCGAGCCGCGTTTGGCTCGTTCGCT |
| CGCGACGGTCAAGACGAATTCGTAAAGATTCTACAAGAGTTCTCGAAACTCTTTGGA |
| GCGTTTGATATCACCGAGTTTTTACCGTGGATGAAATGGTTTAGTAATCGCGATTTC |
| AGCAAGCGGTTGGAAAACGCAAGGAAATCGCTGGATGGGTTCATAGATAGAATCAT |
| CGATGCACATATCGAAAAGAAGAATTCAAGAAAACAAGACGATGATGGCTTGGAGG |
| ACGACATGGTCGATGAATTAATGGCGTTTTATAGCGGCGAAAGCGGTGAGAACGGC |
| GGCAAATCTAATGATTCACTGTCTTCATTTAAACTCACTAGAGATAACATCAAGGCC |
| CTTGTCATGGTAAATAGTTTAAATTAATCATTCAAAAACCATAAGTTATTAATGAAA |
| TGATTTTTTTTATTTAGGATGTGATGTTTGGCGGGACGGAAACGGTGGCGTCTGCGA |
| TTGAGTGGGCCATGACGGAGCTGATGAAGAACCCTCACGAACTCGTAAAGCTGCAG |
| CAAGAACTAGCTGACGTCATCGGATTGAACCGTGAGTTTCACGAATCTGATCTGGAG |
| AATCTTCCTTACTTCAGATGCGCGATGAAAGAGACGCTGAGGCTGCACCCTCCGATT |
| CCTCTTCTCCTCCACGAGGCGGCTGCGGACTCCGTCGTCTCCGGCTACTCCATTCCCC |
| GTGACTCTCGGGTGATGATCAATGTGTACGCGATCGGGCGAGACGGATCGGTGTGG |
| ACCGAGCCGGATGCGTTCAGACCGGGTCGGTTTATGGATAGCAAAGCTCCGGATTTC |
| AAAGGTAGCGATTTCGAGTTTCTACCGTTTGGGTCGGGTCGAAGATCGTGCCCGGGT |
| ATGCAGTTGGGGCTTTATGCTATGGAGCTCGCTGTGGCGCACATGCTTCATTCATTTG |
| ATTGGGAGTTGCCGGAAGGAGGTAGCTCTGATGATCTGGATATGACTGACATGTTCG |
| GTCTCACGGCGCCTAGAGCCACCAGGCTCATCGCCGTTCCGAGTTACCGGCTAAAAT |
| GTCCGATGGTGATTTGAAATGCGTGTTGTTTGTTGAAGAAGTTTTATATCAACTGTT |
| TGCCGTTTTTATGATTCCTTACACAAAGTGTTTGTTGTTGTTTAAGATTCTAATCTAT |
| TTAAACTATTTGGTCCGGATCTTCCGATTTTAAAGGTAAATTCCAGATTAACAGGAC |
| ACGGGAAAAATACCGAGAAAGAAAGGAGTCATTACAAAACCATAAATCAATTCTGG |
| TTCTCCTTAGAACACAAGACCGGTTTGTAAACTAAGCAAAAGCTACTTAGTTAGTAC |
| CTCAAGGGGTAGTGGTGGTGGTGGTTCACTAATCTCCCAGAAGGGCATTCATACGCA |
| ATGTGTCCTCTTCCACCACAGTTTCGACATATCATCAGCCTAGCCGTGCAGTCTCTGC |
| TCATATGACCCACTTGCCGGCAGTTCCTGCAAACACCTCCTCCTCCCTGTATTGGGC |
| TCTGATCCCTCGTGGTCTTCGCTCTTCTGCTGCTAACACATGGGTTTTGGGGCATTTG |
| ATAGCAACGTGACCAGCCAGGTTGCAGTGATTGCACACGGGATCGTCTCTGCAGTCA |
| CGAGCTAGATGACCAGTCTTCCTGCAGTTGTTGCAGGCTTTCTCGTTAGTGCAATCA |
| GCTGAGAAGTGACCTTGCTTGTAACAGTTGTTGCAGAGTCTCAGGTCACCAGGAGGG |
| AGGTGGCGAGCCGTGCAGTCTTTAGCTTGGTGTCCGGCAATACCGCAGCTGTGACAG |
| ATGCCTTCGTTGGTGCAGCTATTAGACATGTGACCTGGTTCACGGCAGTTCCAGCAC |
| ACAGACTTCGCGGAGCATTCAGACAGATTGTGACTGCCAAGTTTATTAGAAGAAA |
| AAAAGACAAGGTATATGTTATTAAGTTATCAGTGTCGGCCACAGAAATAAAATACA |
| AGAATTAGACATACATCATCAACCAATCTAAACACACTACATTATCAAAGCAGCT |
| AATCTACGTTCAAGATTAGTGTATATTAGCACTAAAAATGTAGCAAGAACTTCACTA |

| SEQUENCES |
|---|
| TAACAATCTAAATCAACTTAGAACGTGAAGCAAAGACCATAAGAAAGAGGAATAGA<br>GAATGGATAGGGTGGTTACCCAGGCAGGCCGCAGTTGTGGCAGATAGAGACATTGG<br>GACACTCTCGAGCAAAATGACCAGGTCGCTTACAATTCTTGCACGTATTACTTTGAC<br>TGCAGCAACAGAATTTTAATGTTAAGCATATCAGTAAAACCAATTTAGTTTCTTTCTT<br>CTCGGTATACAGCTAAGCTATGGGTGAAGTATACTAAGAGAAATGCCAGTTTCGATG<br>AGAAAAACCTGAAAGTCCGATGTGAATCTCTTCGGTAAGGATCATCACGGTAAGAA<br>AAACGATCAGAAGCAATCTTTCTGGCCATCGGGTTCCTACTCCTCCTGGGTGTAACT<br>GGATTTATCTTAGCAACAAAACAAACAAACAAACAAAAACACAACCGGAAAT<br>CTGAAACGGAAGTAAGAAAAGTCACGCATTTGGTGTAGCGAATACGAGATGCAAAG<br>TGTGTCTTAATAGAAAGAACGACGGAACATCCTCCACTTTTTAAAACATTAAAAATC<br>ATTCCTTAACATGCGCTAAAACCCTAACAACTCAATCTCTATTGGACTCTTACAAAT<br>CTTCACCGATAAAATTACATCACTACCTACCTCACGGCGACGACAACCAACTTTCCG<br>ACAAGTAAACTGTCAGCAGTTCGACAAATCTGGCTTGCGGCGACCGAACCTGTGTTC<br>TGTGCGACACCCTCGAACACACACAAAATAACGTCATCAGTTGGTATCTTAGTAAAT<br>GGGCTTCAAAAGCCTTTCGTGACCCATTAACAAAGTGAGACACGCCTGACATGTATT<br>AACCAATTACTGTTATGTTCGGTATTCGTTCACTCACCACTTGTTCTTTTCTGATACG<br>GTCCAGTCTACTACTACTATACGTACAAACATCAAATTTGTAACATCATGGGCCAAT<br>ATCCCATATGCAATGTAAATTTCTAATGTGCAAACAAGAGAATAAAATATGTGTATT<br>CTTGTTTCTGCTTTAATTCATAAACATATGGAGCCCTTTATATATAGGAAATTACATG<br>AAAAGAAAAAAAAAAGACTACGAACATGAAAAG |

SEQ ID No: 74
>Brassica_Bo3g093960
CTCTTTTAAATTTTTACCGGATCCTAATCCGTGCGGTTAATATATTTTTTT
TAATTTGTAATATTTGATTGTTTTACATTCACTTAGTCATGAATTTTTTAGCGTGTTA
AACCATCTATTGTACGACGAATATTCGATATCATATAAATAAATTCAACATATATAT
GTATGTAATTAGAAAATTGTATACAATATATAAAAATAATGTTTTTAAAATATGAAG
AAATAAAGAACTATGACTTAGTGTGCCATAGAAAATATTATAAAATAGTTATTCATG
TTTAAAGAAAATACAATTTATTAAACTTCTATAAAAAAATTTACATATAAAATGATC
GATTAATAAAATCAGGGTGTTTTAAGTTAAAATTTAATTTAGGCAAAGACATTAACT
GAACTGGAAAAAACATGAATTAAATAAGATAGTTTAATTTAATTCTCAATGGCATGG
AAGTGTAAATAACTTTGAAAACTAAGAGACAATTTATATTGGTACTTCTCTCTTTTTT
TTTTTGAAAGAATTTTAAATTTATTCAAATAAAAAAAAAAACCTTGATACAGAGATTC
ACTGCTTCCTTACTACAAATATTGAAATCAGAAAAACTTCAAAAATCTCATAATTCC
TTTAGCTTCTTCCAAACCAATTCTCCATTGTTTTTCATGCTTCCCTCCTGCTTTCTTT
CTAAACGAGGTGATTATGTTGCGAACTATCTTGTCCAATCTATCAATCAGACATGAA
ACTGGTTGGGAAGGCTCACCCACCCTTCTCACATTTCTCTCATGCCAAATAGCATAG
GCCACCACTTGCAGACAATATCGCATCAAAAAAGTCATACCTCTCCCTTGACATCCT
TTCACTATTAATAGAGATGTTAACCTCTACTTGTATTTTAGCTCTAAAAAACCTTTTC
TTGTATTCGTAGAGATTTATATAAAGAAAAATCTAAAGATTAGTCTCTTAATTTTGG
AGCAAATTCCAAGGCTTAAATCCTATGTTTTGTTTAATGTGATATAGTACCAACTATT
TCTTTTACGATCAGGGGCGGATCCAGGATTATATTTAAATGGGGGCACATGAAAATT
ATACATTATATTGTTTTAATTGGGGGCACTCCTTATGTTTTATACTAATAACTATAGA
AAATTAAAAGACCCCATACCCTTGGCTTTGCGTCCACCACTGTTTACAACATAGTAG
AAGAGAAGAGAATGTAGTTAATCAATATTATATAAAGGAGATAACTAGATCTCTTG
GTGGTTGAAAGCCAACAACAAATCATTATACGTACATAAAAGGGGCCTAAATCATG
CCAAGGAAGTTGGTCACTCTGCCATGATATAATATATAATACTCTACTAAAAATTAA
TTATTTCATTTATAGAGCTTGTGGAATCCTTATGTATGCACCCACCCTCTTTATACTA
GTCTTCTCTGTTTCGTTTTGCTTAGTTATGCCATCAATTTTTGAATGACGAATTGGATT
ATAGAAGCAAAATATGATGAGATAGCGCTGTACTTTCTTTAGTAACATGTATTTTCA
ATTTGGTACATCCTTTCAAAACGTTATTGAGTACGTAAATGCACAAGTAGATAACCT
TTTCACTTGTAAGATCACCTTAGATATGGGAAATGGAAATAGTTATATCAATGATTA
TTGGCATGTCACATGAATAATAAAATAACAGTATATCATAATTAAAATTTAAACGCT
AAAACTTAATAGTAATATGCCGAATAATAACAAAATGTTTCACAATGACCACAAAA
CAATGTCTATACATAATTTAGTGCCGTATTATTTTTGTATATATGATCTACCACAAAA
AAGTTGTTCATTTTGCAAAAGTCAACTCATTCTTTTATATGAAAAGTCCACTCTTTGA
AAGTTTTTATATTGTTAAGATGAAAAAAATATACTCATAAATGGGGCCAAGTTATGG
TTATAAAAGCTAGCGTTGGCCTTAATAATCACATCATCTCAAATTAGTTGACAAACT
AACAATGGAGTCTCTGTTATCACAAACACTAAACAAGTAATAGATCCCACCCCGTC
AGTTCTTCTTATCACCATCTCTCTTCTAGTTGTAGTCTACCTCATCTCACAATGGTTTA
AACCGCTCTACCCTCCCGGTCCCAAAGGCCTACCCGTAATTGGAAATATGCTAATGA
TGGACCAACTCACACACCATGGTCTAGCCAAGCTAGCCCATAAATACGGTGGTTTGT
TCCATTTACGAATGGGATTTCGTCACGTGTTTGCCATCACATCACCTGACGTGCTCG
ACAAGTCCTCCAAGTCCAAGACATCAGCTTCTCGAACCGGCCCGTGAATGTAGCCAT
AAACTACTTAACCTACGATCTAGCCGACATGGCCTTCGCTCCTTACGGACCCTTTTG
GAGAGAAATGAGGAAAGTGTGCGTCATGAAGGTGTTCAGCCGGAAACGGACCGAGT
CATGGGCCTCGGTCCGTGAAGAAGTAAACAATATGGTCCGGTCTTTTTCTAGCAACG
TCGGTAAGCCCGTTAACGTTGGAGAGCTCATTTTCACATTGACACGGAACATAACGT
ACCGAGCGGCGTTTGGTGCGGCCTGCGAGACAGAACAAGACGAGTTCATAAGGATC
TTGCAAGAGTTCTCAAAGCTATTTGGAGCATTCAACATCGCGGATTTTATACCGTTC
CTAGGGTGGTTTGATTTTCAAGGGATAAACAAGAGGCTTGTTAAGGCTCGTAACGAT
CTTGACGGGTTCATCGATGAAGTTATCGATGAGCATATGAAGAAGAGGGAGACTGT
AAACGTTGATGAAGATACAGATATGGTGGATGATCTACTTGCGTTTTATAGCGAGGA
TTCATCAACTAATCGTAATAAGAACACCGTAAACTCACACGTGATAATATCAAAGC
CCTCGTCATGGTAAGCCAAAACGTTACCTTTTTATTTATTGATTTTCCTCTTAGTAA
TCATTTAATCCTTGTTCACATTTTCTATAAATATATAAGATAATTTAGTTGTAATAAT
GTTTAAGCCAAATTAAAATTATTTCGACCAATTTACAAAAAGAATATTTGAAGTTG -continued

SEQUENCES

ATAGTTTATACACCATCCGTTCACAAAAAAAGTAAAATTTATAGAGTTTTCACGTTT
ATTAAGAATACAATAAATATTTACAATTTAATTTAAACTTTATTTTTCAATACACTTT
CTAATAACTATCTACCAATAAAATTTAATCAATTCAAATATTCACAATTAATGTTTCT
CAAAAGTATACAAAAGTATCTTAAAAATATAGAAAATCTATTTATTTGGAACACGA
ATAAGCTCTAGAAAATCTTACCTTTCAGGAACAGATGAAGTAATATATTGGGATGAC
TGATAGTTTCGATAATATTAATTAGTAGCAATTATGTGTTCCCTCTGTTCCTGAAAGT
AGGATTTTCTAGATTTATTTTTTATTCCAAAATGATAGATTTTCTAAAACTTTAAGAT
ATTTTTAGTAGTTAATGTTGAAAAGTTGTATATTTTTAAGAAACATTAATTGAAAAT
ATTTGAATTGATTGAATACTATTGGTTGATATTTATTGGAAAATGTATAGTAAATTA
AATAATAAATTCAATTGTAAATATTTATTATATTCTTAATATGCGTGAATACTCTAGA
AAATCTTTCTTTCGGGAACAGATGGAGTATTACTTTTCTTGTTTGTATATAAAAATAC
CATTTTGGTTTTGGAAATGATATATATCTTTGTGTTACACTGTTCGGAATCATACATT
TGATTTGAGATGGAATATAAAGTAGTACAGAATATAAATTATTATATCCCAGTTGAT
TATGAATTTGAAATTCGTGATTTTTAACGGTTTTTGATAACTAAAATGGTAGCTCGAT
ATACTAATTTTTTTTTTTTGAACTATTAATTTACTTTTATTACTGGAAGGATGTTATGTT
TGGAGGAACGGAGACAATGCGTCAGGGATCGAATGGGCTTTGACAGAGCTTCTAC
GTAACCCAGCTGAACTCAAACGGCTCCAACAAGAGCTCACCGAGGTCGTGGGTCTT
GACCGACGCGTGGATGATACTCACCTCGAGCAACTAACATTCCTAAAATGCACACTC
AAAGAAACCATGAGACTCCACCCACCGATCCCACTCATCCTCCACGAGGCTATTGA
GGACAGAAAGCTCCAAGGCTTCTTTGTTCCCAAAGGCTCACGCTTGATGATCAATGC
CTTCGCTATCGCACGTGACCCGAAGTTGTGGGTTGACCCGGAAGCGTTTCGACCTTC
TAGGTTTATGGAACCGGGTATGCCTGATTTCATGGGGACTAACTTTGAGTTTATACC
CTTCGGGGCAGGTCGGAGATCGTGTCCGGAATGCAACTTGGGCTTTATGCGATGGA
GGTGGCTGTGGCTAACATCATTCACTGTTTCACGTGGAAGTTGCCTGACGGGATGAA
ACCAAGTGAGCTCGACATGAGCGACGTCATGGGTCTTACCGCTCCCAGAGCCACGC
GATTGATCGCAGTGCCTGACACGCGCCTCATCTGTCCGGTGTATCCTTGACCATGGA
GAGAGTTTTACTGCTCTATTCAGGATTAATGGTTCAAAAGTTTTGTCTTCTCTCTTAA
GATCTTGCTATCTTTAAAAAAAATATATATATATATGTTTTTCCACATTGGGCATGCT
TTGTTTTTTGTTCACAGGGGATTTTCTTCCTCAAAATGTAACTGTAAATAAATAATAA
ATAGGGTAATAAGGTTTTTAGTAATTAAACTCTTCGATTAAAGATGAATGGTAAATA
AACCCCTCAACTAAAATTTTGACGAAGAAAACCCTTAACTTTAATTCCGTTAACGTT
TGTCACCCTCCGTCACAGTATTTTAGACGGAGGGTGACAGACATTAACGAAATTAAA
GTTGAAGATTTTTTCGTCGAATTTTTAGTTGAGGGTTATTTTGCGATCCATCTTTAGT
TGAAGAGTTTTATTACTAAATGCCATTAAATATTTTGAAATATTTACTATCATTTATG
CATTATTTAAAATTAGGTGTTTTCTTGCACAATGTGCAGTAATAAAATTTTTTAATTT
AAATTATATTTAAAATAATTTTATTAATATTTTATTATTTTCTTACCAATATTTTAATA
TAAATTTGATTTAATTATCAAAGTACAACTAAACTGTATTTCTAAAATTTGAAGATA
TATAAAAGAAGTTAATAATATTACGTTTAAAATTATATATATATTTTTTAGATTGTAA
CAATTTTGAAAATCTTTTTAGTAATAAATTGTATAATTATAAAAAATAGAAATAAAT
TATTACGAAAGTGATTATTTTATCAAATTTATAACCAATTTATAAAGCTTTATAAATA
TTTTACTACTTTATAAATAATTAATAAGGTTTAATAATAACTTTATAAGATTAAAGGT
ATGGTTGTTCTCCATAATACAAAAACATGAAGTAAGTAAATAAAAGAAGAAAAGTA
AATAAAAAATATTGTTTTATTTATTAATAAGGTAGGAGTATAATGTATTGGTTCCGA
AAGCAAAGAGAAAAAAATAGTCATGATTATAATTTTTCTTTGATTTCCGAAAAAAA
TAGTCATGATTATAATTATTAATAAGGTAGGAGTATAATTTATTGTTTTATTTATTTA
CTTCATGTTTTTATAGTATGGTGAACAACCATATCTTTAATCTTATAAAATCATTGTT
AACCTTATTAATAATTTATAAAGTATTAAAATATTTATAAAGCTTTGTAAATCGGTT
ATAAAATTGAAAAGTAATGTATATGAATTTATAAATTATCTTAGAGGCTTATAAAT
CTATTGTAAGAGTTACCCTTTTAAATAGTGCATAAGTGACAATAAAGATTTTAAAT
ATTTAAAGGCATTTAGTAATAAAACCCCTCAACTAAAGATGGATAGCAAAATAACC
TCTCAACTAAAAATTCAACGAAAGAAACCCTCAACTTTAATTTCGTTAACATCTGTT
ACCCTCCGTCTAAAATACCATGACGGGGGGTGACAGACGTTAACGGAATTAAAGTT
GATGAGTTTTTTCGTCGAATTTTTAGTTGAGGAGTTTATTTACCATTCATCTTTAGTTC
ATGAGTTTAATTACTTAAATTCCTCATAAATAATAAATGAAATAAATTTGACAATGG
AAGGATTATAAGTACCTTGCATGGAAAGCAACCCCGAGTTGCTGAATTTGAAGCTTT
AGGCCTCTACACCATTTTGCTCAATTTCCGATCTTTTTGTTTCTGTCCAGTGTTGAG
AAGCTTCTTCTCTGGTTGAGCCTTTGGCTATATACACTACCTTTGTTCTTCACAATTG
AAGCATAGCGGCTATCAACGAGAGTTTATTACCCTACAAAGTGTATTCTGACCATTT
ATGTTTCTCATGCATCCTCTAGAATCTACATATGCAACTCAAGGAACACAGCATTAA
CATACTTCTAATAAATCACACATAATGTACTCTTATAGCTAATGAATCGAGTAGACC
TATCATGAAACATTATAAGTTTAAACTTGAATTTCTCAGACCTAGCTAACATCAAAG
CAAACTATCACATAGAGCTTGGATCCCTTTCTGTAAGTGATACAAACCCCCATTAGT
TAATGATTTTGCTTGATACACAACTTTGGGGATGAAAGAATTCTCTTTTGCCTTTAGT
ATATACGTGCCTTATAGGTCAAGAGTTTCAGAGTATTC

SEQ ID No: 75
>Brassica_XP_013607401.1
ATCATCTCTTAACCGACCAGGTAGAACATCCATACGTCCTAATGAACCAT
AAATCCTTCTTGTAAATGATCTTACTCTCACTCTATAAAAATGCATGCTTATTTCACA
CTCCAAGTCCTCATATTTAATTAAATCAGTTCCATAACATGAAACAACATGAAACAT
TTCATGTTATGCCATAATATATAACCTGCAAATGAAAATGTAAAATGTGAGTAAGAT
TTTTAATAGTTCACACACCATCAAAATATATATTTCCTCCTTAAAACTTCATATTCTA
TCATATCTACAAAGTTTAAGTCTCATTCTATTTCTCCATAAATTGATTATCATAACCG
ATACGCTGGCTAAATTTTGAGCAATTACAATTTTGGGCAGTTACAATTCCCTAGAT
GAACCATATATAACACGAAAAGGGGGAAGCACATTTTATTATTCGGAAAGAGAGAT
TCATAATGACTTTTAATTAGTTCTAACAATGGAGACGAGAGTGACACGAAGATGTGA
AAACAGAAGAAGCCGATGTGTGTTTGATCTATTTGTATTTGCCTTTAACTAAATAAC -continued

| SEQUENCES |
|---|
| ATTTCCTTTAGATAGGTATGTTTATTAAAAGATTCAAAAAATGCATATTATATTCATA |
| TAATTTTAGAGTTACATACATGTTTAAATTATGAGTGTTCATATATATGTCGAGTTTA |
| TTTAGATACAATGTACTTAATTAACAGCATATACATAACTTTTTCTAACAACCAATC |
| ATGTTTGCTAAAGATAAAATTCAAAATTCAGAGAGAAAAAAACAAAATAAAGTGAA |
| TAGTTTTGAAACCCCCCTTTTATTTAAAAAATATTTATTAAACATCATAAATTGTGTT |
| TTATTAAATCCAATTTGTGTTGTTCTTTGTTGATCAATATTATTTCTTGTTTAGGGTAT |
| TTTTTCTTGTTTTCTTTACTTTTATTTATTTTTCTTTACTTTCTTTACTTTTATTTACTTT |
| ACTTGAAATTGAATGTGTTTTTTTTCGCATCAAGGCAGAAACCTTGTCATAATATCTT |
| AGTACCTAGTTTCAAAAAAAAAAATCTTAGTACTTGATAAGTTTAATGTTTTTTTTT |
| TTGAACTTCAATATGTTTGTTTGATGTTTGGACGTCGTTCCCATCTGTTAAAATTTTCT |
| CTTTACTTTTTTCGTACATCAAATTTTCTTTTTACTTAAATTAAATATTTCTAATCATA |
| ATAATATTTTTTGCAAAAGCACACGAGGCTAAAAGATTGTCTCCTATAAAAACAATC |
| CAAATTATAAGATGAATTTAAAATCCTTTTTTTGAACGGCAATGCATTTAAAGTCCA |
| TACATATAAAAATGTACACATTACCAAACAAAAGCACCATCGTTTTTCACGAGTCAT |
| TCCACGATGTGACAAATATTGACCTACCAATACCATCATATGATTATACTGTCCATG |
| TGATCATAAAATTGGCTAAACATCGAGTGAGATCATTGGTTGGTTTTGTTTATGATTT |
| TGTTGAATATCATGTTGTCCCACAAAAGATTTTACGTGGATAGCCAGATAAGACGTC |
| GTCATTGCGAGACGAGGCCTACCATCAAAGCTGAAAAAGCTAAAGAAAAATCCAAC |
| AGTACCATCATACTGACAATATATTTTAACTTAGACATGGTTACCAGACTACATAGA |
| AGATATGAGATCTCGCTTGAACAAAAGATTCTACAGCTTAACTTCAAATCAAAGTTC |
| AATCAACAACGGATTAACCACTACTAAGTTTGCTCCACTCTGTCTCGCTCACTCTAA |
| ATGTGCTCTATGTGCACCTCTTCAACAAAAAAGGTCTCTAAAGAATTTTTGTCGTC |
| TACCTAATTTAGTAAATATAGTGAGATGATAATGCAAATATACATGCCATACAAGCT |
| ACTTATCGTTTTCACCAAAATACTATATAATAAGCCCTAATGATCACCCTGAGCGTT |
| GTGACTTCTTTGGTTGTTCTTTGCACCCATGTTCACAAGAAACACATTATTAAAGACC |
| AATTTCAACTAAAATAATAGAAAACATACACAAAAGAGGTATTAGAATTGAGGTAG |
| TTGTTAAGTCGATATCAATCACATAATTTCTTAACAGACATAAAATAGACCCACGCA |
| CACTAACTTGTATCAAATGTATACTCTAATGACACTCATCCTTCTTGTCCCTCTTCTT |
| CTTTTTCTTTTCCGTCACCTCCTTTCACGACGGCTAAGGCAGCGGAAACCATACCCTC |
| CGGGACCCAAAGGCTTACCCATCATTGGCAATATACTCATGATGAACCAATTCAACC |
| ACCGTGGCCTAGCCAAGCTCAGCCGCACATACGGTGGACTACTTCACCTCCGCCTCG |
| GAATTTCCCATCTTTTTGTAGTTTCTTCTCCTCAAATCGCACGTCAAGTCCTCCAAGT |
| TCAAGACCACGTTTTCTCAAACCGTCCAACCACAATAGCAATCCGTTACTTGACCTA |
| CGGGCAATCCGACCTAGCATTCTGCAATTACGGCCCGTTCTGGCGAAGGATGAGGA |
| AACTCTACGTTATGATGCTCTTTAGCCGTAAACGGGCCGAGTCGTGGGCCTCTGTTG |
| ACGAAGAGGTTCACAAAGCGGTCCGTTCTGTAGCGGCCAATGTCGGAAAACCACTA |
| AACGTATGCAAAGTCGCATTCTCCTTAACAAGAGACATAACGTTCCGAGCAGCGTTC |
| GGCTCCTCGTCGTCCAGTTCTAACGAAGGCAGACTAGATGAGTTCCTTGAGATCATA |
| CAAGAGTTCTCTAAGCTCTTTGGTGAGTTTAATGTAGCGGATTACGTCCCGTCTTGGC |
| TCAGTTGGATAGACCCGCAAGGGATAAACAAGCGGGTCGAGAAGCCCGAAAATCT |
| CTAGACTGTTTCATTGAGTCAATCATCAATGATCACTTAGACAAGAAGAAGACAGA |
| AAAGAACGTTAACGTTGACGAGGTGACCGATATGGTTGACCAGTTACTTGCGTTCTA |
| CAAAGAAGAAGTTAAAGTCAAGGACTCAGAGACCAAAATCAATCTCGATAACATAA |
| AGGGCATCATCATGGTAAAAAATTAAACATACTCCATTCCATCCGTTTCAAATTATA |
| CACTATTTTATTAATTAGTAGAATGTGCAATTTTTTGTTTATTTAACTATTACAATTAT |
| GTAGCATTTATTGTTTAATTTTTTAATTAGTGATAAAAGAGGTAAACTAATAAAAAT |
| GTCATTAAAATCATTAAAATTATATTTATTTTAAATCAAAAATTTTACTCTATCAAAA |
| TAATTTTTTTAAATAAAATGAAATAAAGGATGTGATGTTCGGAGGAACCGAGACGG |
| TGGCATTAGCAATCGAGTGGGTACTAACCGAGCTACTCCGGAGCCCCGAGAACATG |
| AAACGGGTCCAGGACGAGCTAGCGACTGTGGTCGGGCTTGAGCGGTGGAGCGTGGA |
| GGACACGCATCTTGAGAAGCTCTCTTTCCTAAAATGTGTACTCAAGGATACTCTCCG |
| GCTCCACCCGCCGTTCCCTCTCCTCCTCCACGAGACGGTGGAGGAGGCCGAGGTCTC |
| CGGTTACTTCATTCCCAAGGGATCACGTGTGATGGTCACACTTACGCTCTTGGGCGT |
| GACCCGGCTTCGTGGTCCGACCCGGAAATATTCAACCCGAGTAGGTTCTTGGATCCG |
| GGTGCTCCTGATCTGAAAGGAAACAGTTTCGAATTCATTCCGTTCGGGTCAGGTAGG |
| AGATCGTGCCCGGGTATGCAACTCGGGATGTATGCGTTTGAGCTTGCGGTGGCTCAT |
| CTTCTACACTGCTTCACGTGGAGATTACCGGACGGCGTGAAATTCGGTGACGTGGAC |
| ACCATTGAAGGGCCGGGTCTCACGGTTGCTAAGGCTAACTCTCTTGTGGCAGTGCCG |
| ATCAAGCGCCTCCTCTGTCCCATGGTCTTGGAAAGCCACAATGTTTAAAAACTTGTT |
| TTCATAATTATTATTTTACGTTGATATTTTCTTGTGTAATGTATGTATGGTGTTCATGT |
| TTACGTTAGCATTATTTTCTTTAATATAATATCCAAATAAATACATAAAGCGTAAAA |
| TATGGTTATTTTAAAAATATACTAACATCAAGAAGAAAACCATGTTTTTTTCAAGAC |
| TAATATAGTCCCAATGAACATTAAACTAGCTTATGACCATTTTCTGAGTAGTAGATC |
| CAATCATATCTAGCATCCCACAAGAATCGTGCGCCGAATTTTATGAAATAACGAGAT |
| TCTTCATGTATTATGGCAGGACATAAAATATTTCATGTTGTGAATGTTACGAAACTG |
| ATTTAATTAAAAAAAAAAATTTGAAGAGTGCAATAAACATGTTTTTTTATAGAGTG |
| AAAGGAAATCATTTACACGAAGGATTTTTCATCCATATGTCATAAGATCATTGGAC |
| GAGAAATCTTTCGTAAAATGATTTCATTTCGTTTTATAAAAAAAACATGCTTATTTC |
| TCTTTCCAAATCCTCATCTTCTCTATTAAAGAGAAGTACCATTTTTATCTACTATTT |
| AGAAGTCTACTAGGACCATTTCATTAATCACATAATATGATATAATAATTAATAAGA |
| ATATTAATAATAAATTAATTTTAACTATAGATTTGAATTTTATTTTCAGTTATAACAA |
| AATCTGTTGAGAAAAATCTAACAAAATCCTACTAAATTTTTAAATAATTTTTATTTAA |
| TATTTGTTTAATTAATTTCGTAATTAAATAATATAATGCTTTCATTTAAATAAATTAT |
| CATCTACCACTAAAACGGGTTCAAATTTTTTAATCATGTCAGATTTGTTTTATACAAA |
| TGATGTTATTAACATATGTTAAAAATTTATTTCTACAGCTATATATTTTCAAAAATCA |
| TATGTTGAAGAATATTTTTTATTTGATGATTTCAAATTATGAAAACTCGAAAACGTA |
| ATAAAAAAGGTAAAATGTATAAAACAAACCCCTATATTAATAAAGTAATAAGAAAC |

```
TTAAACAATAAAATTAAAAAGTTATAAAATACTAAACACTAAAATATAAATTGTAT
ATTTAAATTTATATAATAATATTAAAATTAAATATTTATAAAATGAAAATATACCCG
CACTATGTGCGGGATAAACTCTAGTTTTTAATTAAATTAGTTATAACATTCAACAAC
ATGCAATATGTCACGTCTTGCCACAATATATAATCTGCAAATGAAAATATAAAATGT
GAGTATAAATTTGTTTATAGTTCACACACCATCAAAATATATATTCCCTCCTCGAATC
TTTCGTATAGTATCATAAAAGTTTAAGACTCATTCTATTTCTCCAAAATTTGAAAATT
TCAAACCTATTAATACACGAAATGCAAGTTTGAAACATATATACACGTTGTCAAAGA
AAAAAAACATATATACACACGCAAAGAAGAAATTTCGAATGAAGACAAAATAGTG
AAGAAAAATAGCGTTGGATGTGTTCATCATAATATGGGATTGTGAAATTTTTATTTT
CATCAATTTCAATGGAGTTATAAGAATGAAGCCAACAACCGGGAATGAGAATGCAA
AGGAGGAAAAAAGTTTTGTTTTTTCTGGGTAAAAAGAAACAAGGTCGTTTTCAAAC
AAACATTCCAAGCAATTTACTGAAATATCGAAATAATTTTTTTTTAAACTCTTACGC
TAACAAGAAAAGTAGGTCGTTACTCCAGAAATACTGAACCGTACTTAAGAAACTGC
AGCAAACACGAAACTGGACTCGTTAAAAGACAAAGATAAAGTTAAGCAATCGTCA
TTCAAGAAACAGATTAAGAATCGAAAGAAGCATTAAGATTACCTCAACTCGGAGAA
TTAGATGCAGCAGCTAGCTAGCGATCTGAATGTTTATCGAGAGAGAGAGAGAGATA
GAGATAGAGTGAATGAGAAAGGAAGGGAGTAAGACGAAACACAAGAAGAAATTCT
ATCGTTAGTGAAAGAAACTCAAGTTTTTAGCAAAGGCATTAGATATATGGGAATAA
GACTATTGGTGAGGAATGGAACAAGAAGCTGTGGTCGGTTGTATAGGAGTGAGGTT
AGATTTGGTATAGTGTGTCAAAGTAAAAGGCAAATATACGATTAATATAAGTAATC
GTGTTACTATGTCGCAAATCATAAAAGCATCCTCCTAAGTACGATATGTATAAAGTA
CGTTAAGTATATCGATCGCTATATAAAGCCAGTCTGGTAGTCTACACTCTATACATA
TAGATAGGGACATGGATGCCATGTGCCATTCTGTATTGTACATTCAACTGCCATTAA
TTTCCTTGTCCCAGTCTTCTTTTGAATCAATTATCATGCCTTTCTCGAATTATTGTACTC
TGCTATTGATCAATTTATTTGTCCAAATGTACTCTTCTTTTGAATTATTTACGGGTGTC
TTCTTCCACTACTATACTACTTTGTTTTGTTCACCTTTGAAGTGTTTGGAATAAACGG
TTGAACGTGTTTAGGGTGA

SEQ ID No: 76
>Eggplant_c18725_g1_i1|m.19489
ATGAAAGAGATGGTGCAAAAAAATATCAATTCAATTCTTGAAGCTTTACA
AGCTAATCCTATGCTACTCTTCTTGTTTATTATCCCTCTCTTCTTCTTATACCTTTTCTC
GACGTCTAGCCGGAGACGTTATCCTCCAGGTCCAAGAGGGTGGCCTCTCATTGGTAA
CATGATGATAATGGACCAGTTAACTCACCGTGGTCTTGCTAAACTAGCAGAAAATA
TGGTGGTGTTATGCACCTCAAAATGGGTTATATCCACAAAATTGTAATATCTGGTCC
GGAGGAAGCTAGACAAGTACTACAGGTACAAGACAACATATATTCGAACCGTCCCG
CGACCGTAGCGATAAGCTACTTAACGTACGACCGTGCAGACATGGCTTTTGCTGACT
ACGGACCGTTTTGGCGTCAGATGAGAAAATTGTGCGTCATGAAACTCTTCAGTCGCA
AACGAGCGGAGTCATGGGACTCAGTTCGCGACGAAGTGGACTCACTGATCAAGATT
GTTACAACCAACGCTGGCACCTCCGTCAACTTAGGGGAACTTGTTTTTGGTCTCACT
CGTGACATTATCTACCGAGCTGCTTTCGGGACTAGTTCAGCTGAAGGACAAGAAGA
ATTTATTAAAATTTTGCAAGAATTTTCGAAGCTATTTGGCGCGTTTAACATGGTTGAT
TTTATTCCATGGCTAGGATGGATTGGTCAGCAAGGTCTAAATGTTAGGCTTGCTAAC
GCACGGGCATCTCTTGATGGGTTCATTGATTCAATAATTGATGACCATATTGAAAGA
AAAAAGGCTAATGTTACTATTGATAATGGTGACAGAGAAACTGATATGGTGGATGA
GCTTTTAGCTTTTTACAGTGAAGAAGCTACAGTAAATGAGTCTGAAGATAATTTGCA
GAATGCTATAAGGCTTACAAGGGATAATATCAAAGCTATCATCATGGATGTGATGTT
TGGAGGGACAGAGACAGTAGCCTTCTGCAATAGAATGGGTGATGGCAGAGCTTGTGA
AAAAATCCAGAGGAGCTTAAAAAGGTACAACAAGAATTAGCTAACGTTGTCGGACTC
AATAGAAGAGTTGAAGAATCTGATCTTGAAAAATTAACCTACTTAAAATGTTGTTTA
AAAGAAACGCTCCGTCTCCACCCTCCGATCCCTCTCCTCCTCCACGAAACCGCGGAG
GAATCGACCATCTTCGGGTACCATATTCCGGCAGGGTCACATGTTGTCATAAATTCA
TTTGCCATTGGACGTGACAAAAATTCATGGGAAGATGCTGATAGTTACAAGCCTTCT
AGGTTCCTTAAACAAGGTGTCCCAGATTTTAAAGGAGGTAATTTTGAATTTTTACCA
TTCGGGTCGGGTCGGAGATCTTGCCCCGGTATGCAACTTGGGCTTTATGCATTAGAA
ATGGCTGTGGCCCATCTTCTTCATTGTTTTACTTGGGAATTACCTGATGGGATGAAAC
CAAGTGAACTTAAAATGGATGATACCTTTGGGCTTACTGCTCCATTGGCAAATCGAC
TAGTGGTTGTGCCTAGTCCACGTTATTGTGTACACTTTATTGA SEQ ID No: 77
>Eggplant_sm_67_3_v1_EVM112823_1_
TTATTTCATCATAATAATTTTTAAATTTTTTATCCAAGCTAACATAAATTA
AAATGGATGGATTATTAATTAATCATGATAATTGCATAAATCTTTCTTTATCTTGTTA
AATTTATGTCCAATCAATAGATAATCATAAATTAAAATGGCCCCCTTATTTAATAAA
CCTGCCCTCATATTATCTTCAATCGATCAAAAAGATTTAAGGGGTCGTTTGAGAATT
TACGTGGAGATTAGTTATATTGATACTAGTCATGTTAAAAATAATTATATCAATATT
ATTATTATTAAAAATAATATTTATGGCATAAGTTTGATTTATACAAAGATTTAAGAA
ATTGTTTATTTATAAAAATACTTTTCGCCTTGTTTAGTAGAAAAAAAAATTCAAAGA
ACCTCAAGGATATGTATTTTTGTAAGTTTGTTTTATTTCTGTAAACAACTAGTTTGGG
ATATATTCATAATAAATAATCAAATAAGGAATAAGACAATACAATTTATTTTTGAAA
ATTACTTGGAATATTTATGGCAAATGGGACCTTAGATCTAGGGGTGTGCAAAAATC
GAACTGACGGATAAATCGAATCGATAAAAATATTATTGATTTATTGTTATTGGGTTA
TTAGGTTATCGGATTTTTAATAGTATTTGAAAAAAAACTTATTGGTTATCGGTTCGAT
ATCAATTTTTACTATTGGATAAACTGATAACCCAATAAGATTATATAAATTTACTATT
TTACCCCATCAAAAATATTAAATATTAATAATTTAATAGTAATAGGACAATAATA
GTACTTTACCTATTTTAATCTTTAGACTAGTTACCCACTTTAATAATTAATTATGGCT
TTTGTAAGTTAGCAAATGTAGCCTTCATACGTCATTTGCTTTTATTGATGCAAATTCT
```

-continued

| SEQUENCES |
|---|
| TATGAAAATTCATTATTGTCGGGTAAATCGAAAACCAAATTGTTAAAGATTTAAAAT |
| CGATAAATCAAAAACTGATAAAAATTATTTTATTGATTTGTTATTAGTTTTATATATT |
| TAAATACTAAAAACTAATAAATCAAATCAATAATATGTAAAATCGAACTAAACCGA |
| TCGATGCACACCCCTCCTTAAATCTATCACTTCATGAGCAGAGCAATTACTCGCTTTA |
| ATTAATTTATGGCAAATTGCACTAGCAAGTAGAAGTATACATAGGTCTATTTGTTTTT |
| TTTTTATAGAAAAAATCAAATCAATTATATTGATTTGTTAAAGTTATAAATCAAATC |
| AATCTAATATTTATTTTTCTTTTATAGTTATACCGTAATTAAAAAAGAGATAGAATTG |
| AAGAGGTTGTTCTTTTGATTGTGTGTGATTTAATGCTTAATGGCATCTCAAAGACATT |
| GGAATAAATAAAGTTTAAAAAAATAAAATGTACAATGACATCTTCAAGACATTGTTT |
| TAGAAAAACATATCAAAAACTCACGAAATGACAATATATTTAATTTTTTTGGTCATA |
| TTACAAGCCTAAATATGAAATGATATATGTAAAAGTTAAAATTTATAGACTAGTTTT |
| AAAAAATACTTACAAAGCATATTATAATAGTAAATAATTATGTATAAAAAAACTTA |
| AATTATAAATGTATTATGTCAGTTTGATTTAAATTCGATTTGATTTATTTTTTTCTATT |
| GATTTATTTTTTCAACACCAAATCAATCAAATCAAACCACTAATTATTATTTTTTAG |
| TCAATTTCTTGACGATTTAATTTGTACACTCTACTTGCAAGCGATATTTAAGAGAATT |
| TATATATGATATCATGAAGTACAAATTGAAAATTATTTCTTGACTATAGTTTCTTGAC |
| ATTATATGTAGTTGAGCTAAATATCTAACACAATATCCAAGCCAACTTGGTGATGAC |
| ATTCAAATGAAACTTGTATATATAGACCCCCATCATTTTGTATACACTCAAAATATT |
| AAATCTAGCAAGTACATTCATCTCACAAAAAATTCAAGTACCCCTCATAAGATAATG |
| AAAGAAATCATACAAAATAATACTTTTTTCATACTTACTACTAAAGAAACAAACCTC |
| ATGATGCCACTCTACTTCATTTTCCCTATATTCATCTTTTTCTTCTTCACTATATCAAG |
| ATTAAACAAGAAAAATTTTCCACCAGGTCCTAAAGGGTGGCCTATAATAGGCAACA |
| TGATGATGATGGACCAATTGACACATCATGGCCTAGCAAAATTAGCAAAAAAATAT |
| GGTGGTATTTTACATCTCCAAATGGGGTATCTTCAGATGACCGTGGTGTCAAGTCCA |
| GCTGAAGCCCGTGAGGTGCTACAGTTGCAAGATACCATATTTGCTAATCGTCCTACA |
| ACTATAGCGGTGGAATATTTATCATATGCTCGTGCGGATATGGCTTTTGCTAACTAT |
| GGACCCTTTTGGCGTCAAATGAGAAAATTGTGTGTCATGAAACTTTTTAGTCGCAAA |
| AGGGCTGAATCTTGGGACTCAATTCGTGATGAGGTTGAATCCATGACTATGGCTGTT |
| GCCACTAGGGTTGGTTCAAGTGTCAATATTGGTGAACTTGTCTTTGGAGTTGCAAAG |
| AACATTATCTATAGGTAATTAACGCGGAGAATGAGCAGGTTGAATTAAATCTGAGA |
| AAGTTATGGGGGTGGGGTCAAATCAATGAAAGGGTCAATGATCCAATATGTCAA |
| ATAACAAGTCTTAACCTAAATCCTTCGACTTGATTTGACCTTACTTGACATGAACCCC |
| TTCTTTTTTATCTTGCTTGTTTACCAAATAAATATGAAAGCTAATATATTTTTTAAAA |
| ATTATTACTTTATACTCTTACATATTTACATGATTCTCGTTTTTCCAAGAGTTTTTAAT |
| TTTGTATATATGGATATGAGATTCATTTGATCTGTCAATCACATCTTTTTTACTAGTT |
| TTGATTCAAAAATTGAATAAGTTATTCCGAATTCAATTTATTAATTCCTAAAATAAGT |
| TGATTTTGTCATCTCTATCTACAGGGCGGCTTTTGGAACATGCTCGAATAGGGGACA |
| AGATGAGTTACTAAATATCATGCAAGAATTTTCAAAGCTTTTTGGTGCATTCAACTT |
| GGCTGATTTTATACCTTGGCTTGGATGGGTTGATCCACAAGGGTTAAATAAAATGAT |
| CATAAAAGCTAGGGCATCCTTAGATGGTTTCATTGATACAATAATTGATGATCATAT |
| ACAAAGAAAAAAGACTAATAATTATAATGATGAAGGAAATAATAATGATATGGTGG |
| ATGAGCTCTTGGCATTTTATGGCGAAAAAACAAAATTGAATGACTCTGATGATTTGA |
| CGAATGCATTGAGGCTAACAAGGGATAATATTAAGTCCATTATCATGGTAAGTTCAA |
| AATCTTGATGTTCCTATTTCTTTATAGTTTAATTATACCTATCTTTGGTTTCAGTATGT |
| TGATAGTGTAAAAGAATTTTTAATATTATTAAAATCAACTATTGATAAAAAAAATGA |
| GATTTATAATCTAAATCAGATATTAGGTCAGTTAGGGAGTTTAAAGTCATGATACAT |
| GTTTGATAGAATTCAGTTACTCTTAATTTGCTCAAACAATATATTTATGCTACAAAAT |
| TTATTATTATTATTATATATGTATGTATGTATATATTAAATTTAGAATTTAATCAT |
| AATTAACAATTGAAATCATTATTCTAACCATCAGAACTCATAAAATTAAAATTTTGA |
| TTCGGTAGTTGCCCTAAAAATTGCACCAATAATGTAAACCATACTTGGCCTACTGTC |
| ACATAATTGTGAGTAGGCCTACTGTCACATAATTGTGAGTAGGCCATGCATTGAAAT |
| TATACTTTTTAATGTTTATAATATTATTGAACGCTTATTTTGGAGTTTTATTTTCTTTA |
| AAAGAGAGAGAGAGAGAAATTCAAAATATAGATTGAAAATATAAATATTTTTACCA |
| TGATCACCACAAAATTTTACCTATTATACCTACTATCTTATGTATCTTAAATCATTAT |
| ATACGAATTAAATATTCATAATATCTTTCAAATGATTTGACAGTAAATTTACCATGA |
| CAGGATATCATGTTTGGTGCCACGGAAACCGTGGCATCCGCCATAGAATGGGCCAT |
| GGCTGAGCTAATGAAAAGCCCAGAGGATCTCAAAATGGTACAACAAGAACTAGCCA |
| ATGTTGTTGGCCTCCATAGAAAAGTAGAAGAAATGGATTTTGAAAAATTGATCTTCT |
| TAAAATGTTGTATAAAAGAAACTCTTCGTCTTCGCCCTCCGATCCCTCTCTTAGTCCA |
| TGAGTCCGTTGAAGATACCACAATCAACAATTACTATATACCAGCTAAGTCGCGTGT |
| TATTGTGAATGCATGGCTATTGGACGTGACAAAAACTCATGGGATGATCCTGAGA |
| GTTTTAAACCTTCTAGGTTTTTGAAAGAAGGTGTAGCTGATTTTAAGGGTGGTGACT |
| TTGAGTTTTTACCATTTGGATCGGGTAGAAGATCTTGCCCAGGTATGTTCAGACAGA |
| ACTAAAATTTAAAGTTTTTGAAAATATATGAGTTCAAAACTTAATTACATTCATAGT |
| GTATTCCAAGAAAAATATAATGGCACATTCTTAATATAAATAATTTTAACTTTAAAA |
| TTTTCTAATGTTTATAACAATTATTGTAGTCGTAAACTCAGTCCATTCAGTTTAAAAT |
| GAGAAGTAAAGTTAAATAATTCATTTTAAAAAAATATATAAAGGCATTATTCTTTTT |
| TTAAACAGATTAAGAAATAAAGTGTGTCACATGAAATGGAATAAATAAATATTATA |
| TTTTAATAGCTATATAAGTATCATAACATATTTAAGATATAAGTTTCAAAAGTATTTT |
| CAGTTTTCTTGATTATATTTTCATTCAAACACCCTTACATAAAATAAAAACAGGCAG |
| GCAGAGTACATATTTTAGAATATATTTAGCATATATATTTAATATTATACTATATAT |
| ATTGAAATATGACAAATTCAAAGTGTGTTACATGAAATAGAATAAAGGAAATATA |
| TTTTAATAGCTATATAAGTATCATAACATATTTAAGAAATAAGTTTCAAAAGTATTTT |
| TCATTTTTCTTGATTATATTTAAACATCATTACATAAAATAAAACAAACGGAGTACA |
| AATATATTTAAAATATAATTAGCATATATATATATGTTTAATATAATATATAATTGA |
| AAAATGACGAGTTCAAATCAATCCTTGTGGTCTAATCCTTTCCTGGGATAAAACTAC |
| ATGCGATAAAATTTTACAATATGATTCTTTGTTGAATCTCGATCAATACAGAATAAA |

SEQUENCES

```
AGCTTTAGTATTTCGATCTTGTAGTTTAACCCTGCCCTTCGATAAAACAATAATATAC
AATAAAACTTCATGATCTAATTCTTTATTGACTCTCAATTCATACTTAGCAAGAGTTT
TAGTGTTCCGACTCGTGAGAATTTCAAGCATGTGTGTTTGTGTAGGTATGCAAATGG
GATTGTATGCATTTGAGATGACATTGGCACATCTTCTTCATTGCTTCAATTGGGAATT
GCCAAATGGAATGAAACCAAGTGACATTGATATGAATGATGTTTTTGGACTTACTGT
TCCTAAAGCTACAAGACTTGTGGCTGTGCCAACTCCACGTTTGTTATGTCAACTTTAT
TAATTTTGTGAACTAATAATTAGTTAGGAATTCTTAGATATTATATAAAAATATACA
AGTATGGTCATGGAAATAAATTCTTGAATGAGTTGATCATGGAATATAGAGAAAAA
TATTGTGAAGTTATTGGTTTTCTTTCATGTATTGAACATGCAATATATTGGCAAACA
AAGAAAGTGGATATCTTATATTATTTAATATTATTAACTGTTAATTTAAATATTATAT
TTGTGTTGATAAAATTTTATTATGACATATTGTTATATGTGTCTTTAGGTAATGATGA
AAAAATTTCAATCTTGTGTGACGATCAACTTGATGTGATTACAAAAAACATGTTTTT
TTTTTAATCTTAGTTTAACTTAAGTCACATTTATTTATTTGCACTTAATAAAAGTCTTG
ATCTTAATCATCAACTCTAAATTTCAACCATTCAGATCTAAATCATGAAGTGCATTTA
ATTTTTTTCATGTTACGATCACATAGTACATTTGAATAAATTTAAATGATTAAGATA
TATAACAAATAACATAAATCAATGGAACATAGTATTGGCACAAATTGCAAATCTAC
GTAAAAGTGAAAACTCCTGTGGTAGATAGGTCAAAAAAATGATGAAATTTTTTACTA
TGGTCTTTTTTAGTCCACCTCAATTATTCCGACGAATATATGTCGACTTGGCACATCC
CACCAACAAAGATACCAAACGACGTAATAGATAAAAAGAAATCTCCTTATGTAATA
CACAATTCTCAAACTAACATGTTTTTTGGAAAGAAACAGGAAACAGAAGTTAGCTG
ACCTACTTTTCATTAAAATTTACAAAGTTGCATATTCTTGTTTCAGAATCTTACATGC
TAAAGCTTTACAGTTGGTAAATATGTGGTCACAACTCACAACAATGAGTAGTCTACA
AGAAAAAGAACTGTCAAATCTCCATTTTTACAGCACGACGACCGAAAACAGGATAA
TACGTATCCAGCTCAAGTAGTTCTAAGATCTCTTGTGTAGCCCATAGATACGACGAA
TGGCCTTCGATGAATTCAGTTACATCAACCTGTAAATGGAGTACCAATGAAATTGAA
CTTCAGTTAAATAAACAACTGCAATACAGATAAAGATGGGAATAGAACTTACATTCT
CAACACCAGGAACCTCAACTGGTTGAATTCCAGCCAAGCCTTGCGTAAGGAGACTG
TTTAGAGAAGAAATTACAGAAGTCACAAGAAAGAAAGGCAGAAAACAGCAAATCA
AACACGAAAGCAGATAGTGCGGAAATCCTTCAAACAGCGGCAGTACTTGACATGTT
CAACATTAGTACTATGCTTGCGGGCAATGCATACCTGGCACGAAAGGCAACTCCAA
GCATCCAATCATTTGTAGAATAAGCATTCACAAATCTACCCGCTACCATCTGCAAAA
CAAGAACAGCGAGCTTCAGATAGTAATGAGGTCGAATCCTATACTTGTAAGGAAAA
CAAAATATGAACAAAGGGCATGCGGAATAGGGGAAGACCAACTATAATTAGAAG
TACTTAAAATAAAGAAAAACACGAGACCGATAACCTTTCTAGTAGCTTCCCAGTTCA
TATCCTTAATTGCAATGGGTGCCCCAAGAAGAACGACCCTTTCCACAAGTCCAGCTG
CCAATATTTAAGTACTTCAGGATCTTAAAGCAAATCTGAATGACCCTAAAAGAATAT
TAATAATAATAACAGTATGCATATTATGCATTATCTTTCATTAATGAACGTAAGCAC
AATGCTTTGTCTTCCACTAATAATAGTAAGCATATTATGCCTTATCTTCCATTAATGA
AAGTAAGCACCATGCTTTATCTTCCATTAATAAAAGTAGGCATATTATGCAATATAT
CATTCATTAAGAAAGATAATGCAATATATCTTGTCTTCCATTAACAAAGATAATTA
TGTTAAGATTTCAAGTGGACGATAATTTTATTTGGAATTTATTCTCCACTTGGGAATG
TTTCCACTTT

SEQ ID No: 78
>Potato_XP_006340697.1
ATGATATTGTGTACCCTGATTTCGATTTGTTTGTTTAATTATCATTTTAAG
AGTAAATGATTTCTTTTTCAAATACTTTCTAAATATTTGAAATTGTTAACTATATATA
TTTTAACTTATAATAGTTGTTTTTTAAATATAATTTTTAAATAAATGAATTTTATTTTT
AAAAAATTAAATTTTTTATAACTAATTTCACATTAAACATTAATTTATGTGTGAGATT
AGGAAATATGTACAAGCTTGAGGGAGTTTTTACAAGATTTGACGTTTGCGTGAAAGA
TTAAATATACGAAAAAGGGCTAAAAATATCCCTAAAGTACAGGAAAAGGTCTAAAA
ACACCCTTCATCCATCTTTTGGTCTAAAAATACCCTTTTACTCTCTCTTTTTTTTCAAA
TACTTATTATGTGTCATTTTCTTATTGAATGAATAAAAATCCACCTCTATTAATTTT
CCCCCCATAATTTATCCAAATCAAAACAATATATCTTTTCAAGATCCAAAAAATATA
TTTTTTAAATCTAGACAATTTCTATTTTCTATAGCTCTTTTCCAAAAAAAAAAATTGTT
TTAGATAATTAAAATATTTTTAAAAATATTAGTCATGCCACAATTACAAAGACATAA
TATATTGATATAAATCCTAAAAAAAAGTTGTTCCAATTGGTGCACCAGTCCAAGATT
TGATCACTAATGACTTGGATGACAAGATTATTAGTCAAAAAAATTAAATGCTCTTTT
TTTTTAAAAAAAGAAGAAGATAGAATTGTACCCGCATATAAGTTATGTTTCTTCA
AATTTTATTTGTGTAATTTATTTATTTTCCATATGTTTAAAATTTGTTGCAAACAAATT
GGCATGCCTAGTGGGACCAAATCTGCGCTTCATATCTTCTCTCTTAAATCAAATATG
AAAATCTAAAGCTGCAAAGGTGGAAGAATGAGTTCTTCAAGCCTCGTCTTTGAGTTT
CATCGATTCTACACTCCAACAAGCCTTGAAGCAAGGGGCATTTGTAGACATTGAAAT
TTTGCGGACTCTACAAGACATGTTCAATTCGAATTGGGACTCTAGAAGGTGTGTTCA
GTTTCAATTAGAATTTTTGGAGTTTACTCAACCCTAAACCCTACTTTATGCCTATATA
AAAAGTACTAAACTCCCTTAAAGGAATCGCAAAATATCCATAAACTCTTGGGTATTT
TTAAAGATCAAGATCTCGAATATTCCACAAAAGTAATGGAATATTCATATAGAAGTT
AAATCTAAATCATTCTAGTTCGAGAAATACGTCACTAACGGCCCTCGAATCATGGAT
AAATCTTAGGAGAGTAGAATCAAGAGAGAAACAGAATTGTACCCGCATATTTATCA
ATAAAGTTATGTTTCTTCAGATTTTATTTGTGTGATTTATTTATTTTCCATATGTTTAA
AATTTATTGCAAACAACAATCTCTCAAGGCCTCAATTAATTCATACATTACTTCTTCA
AATTTTAAATCCTCTTAATAAAATTTTTGACTCCACACGCCATGGTCCAGTTCGCCAA
ACTTAGGCAAAAATTTTGGTGAATTTGGCCGTTCAGCTACCTGAAGTACAAGATGC
TAGTGACTAGTTCCCCTCTCATATGATTTTTATTTTTGGTTCCCACCCGGTGTCCAG
AGCCCACATTGAACTGCATGGCTCATTTGGGGGGGGTGCTCCCAACAAGACTTTCTA
CATAGTCAGGGCTCGAACCCGAGACTTCTGGTTAAGGATAAAAACACTTCAACCAG
TACACCACAACCCATGGTGGTCCTCTCATATGAAGTTGTGGACTAGCTTGGGTCAGT
```

| SEQUENCES |
|---|
| CTTTGACTTAAAAGACCAATCTACAAATAGTTTAATATAAAGCTTAATATAATAATA |
| TGTATTGGTATATTTTACTTGACATATAAAGCATATTTTTTCGCCAAATCAACAGTA |
| TACACCAACTTGGTACCGACTGGAAGTGGAATAAATTTGTATATAAAGACCCCATCC |
| TATCCACCAATAAAAGGTAGAACCAAAATTTTGAGTTCATCCCAACAAGTCCCTATC |
| TCCTACATACTCCACCACCATCTCCCAAAATCTCCACTGAAAAACAAACCAAACATA |
| TCAAAACAACAAAGAAAAAAAGAGAGAATTGTAAACAAAATGAAAGAAATGGTAC |
| TAAACAATATCAATTCAACTCTTGAAGCTTTACAAGCTCAGCCCATGCTACTCTTCTT |
| CTTCATCATCCCTCTCTTCTTCTTATACCTTTTTTCGACGTCTCGCCGGAAACGTTATC |
| CTCCAGGACCATTAGGCTGGCCTCTCATTGGTAACATGATGATGATGGACCAGTTAA |
| CTCACCGTGGTCTTGCCAAACTAGCACAAAAATATGGTGGCGTATTTCACCTCAAAA |
| TGGGTTATGTCCACAAAATTGTTATATCTGGTCCAGAGGAAGCTCGTCAAGTACTAC |
| AGGTAGTATTGGAATATCTGACCATCTCATCTAAAAAGAATTTATACGGACGGTATA |
| AATAATTTGTCAGTAGTATAACATAACATATTGTAGTACTACTAATTAATAAGTTTG |
| GGTATCTTATTATTTTTCAAATATTAAATTAAACAGATTATTTAATTTCTAACAGGTA |
| CAAGACAACATATATTCGAACCGTCCAAAGACCGTAGCCATAAGTTACCTAACGTA |
| CGATCGTGCGGACATGGCTTTTGCTGACTACGGACCCTTTTGGCGTCAGATGAGAAA |
| ATTATGTGTTATGAAGCTATTCAGTCGTAAACGAGCTGAGTCATGGGACTCAGTTCG |
| CGACGAAGTGGACTCAATGGTAAAGATTGTTACAACCAACACGGGTACATCCATTA |
| ACTTAGGGGAACTTGTTTTCTGTCTCACTCGTAACATTATCTACCGAGCAGCTTTCGG |
| AACAAGTTCAGATGAAGGACAAGATGATTTTATTAAAATTTTGCAAGAATTTTCGAA |
| GCTATTTGGTGCGTTTAACATGGCTGATTTTATTCCATGGCTAAGGTGGATTGGTCAG |
| CAAGGTCTAAATGTTAGACTTGCTAAGGCAAGGGCATCACTTGATGGATTTATTGAT |
| TCGATTATTGATGATCATATTGAAAGAAAGAAGGCTAATGTTATTAATGATGATGGT |
| TATAGAGAAAGTGATATGGTCGATGAGCTTTTAGCTTTTTACAGTGAAGAAACAAAA |
| GTAAATGAGTCTGAAGATTTGCAGAATTCTATAAGGCTTACTAGGGATAATATCAAA |
| GCTATAATCATGGTAAGTTTTTAACCTAATGCTTTTCCGTCATTTTTTTGTGTGGTT |
| GATACATGTTCCAATTAACGTGTCATAATTTAAATCAACTCGTGGTTTAAAAAGAAA |
| AAAAAAACTAAATTTGTACTTGTGGCATTTGTGGTTAAAAAGAAACATGTCATGTGA |
| CAACAATTTTTTTTTTTTAAACTTGTGGCATCAAATATATCATTTGATCAGGGAAAT |
| GAGAAGGGTAAACTTTGAAGTTTGAATTGATAAGAGATTTAAGAAAGATTCTTTTTT |
| TTAGAAAAATAACTAGTAATCTTAAATATGTCATAATATTTGTGTGATAATAACTTTT |
| TTGAAACTTATGTCATAATATTTGTATGGTTACAGAAGATTCTTGTTAAGGTAAAAT |
| AGGAAGTACAAAGTTGATAATTTTCAAATTTTAAAAGTGACATATTTTAATTAACA |
| AAAAAGAAATTGTTTTACATCAATCGAAAGGAATAGTATATTGGGAAAATACAAA |
| CAAATAAAAGAGAGTATTATTTTAACATAAATTAATTTGATGTTGAAAATCTTGCCC |
| AAAACAAGAAACTTTAAATTTTAATCAGTTGCTACTAGGTAGGATCACTGAACACGG |
| CTATCTCTGGCAGCTCATGTATAACTATCAAGAATAGTGGAAGCTTAGGAAACACTA |
| TTATTTTCGTGAAAATATGTGCAATGTATAATTTTAGTACTTTACTTATATTTTAAA |
| ACTTCCTTTGTTAGATGAAAATTTTGATAATTATTTAATTAAGTTGACTCTTTATGAT |
| TTGTTTTTAGAATAACAAGATGCGTTAAAGTTTCTCAATCATCACAAAATTGATATT |
| AAGAGTGAAAAGAAAAAATATTATTGAAAATTGATAACCTAGTATAATAAAATTTG |
| TGCTACCCCATATTTCTATGGTTTTAGCATCACCTAGCTAGACTTTAATTCAAAAATT |
| TGATGAAACTTATTACTAATTCAATTCATTATATAGGAAAAAATCTCCCTTTAATTTC |
| CAATTTTTCATACAACTTGATCCTAGTGGAATGTCATAAAATAGAAACATTAATTTC |
| CTCTAAATCATTAGCTTCAAATCATTTGTTTTTTGAATGTCTCATCAATATAATAAA |
| CACCAAATATGATTACGACTTTATCTTGTTATATACGATATAATTGTTAATGTCCTAG |
| CTATGGTCTACTATATAGTTTTCTAGAATTAAATAGTACAAAGGAATTAGCGTACTG |
| TACAACTACTAGATCTTATAAGTAGATTTTTATTTATTTATAGGTCTCTCTACTGATG |
| ACATATATCATGAGACTAATAAGTTGATTTGAACTTTCCCTATTAATCTTGATTTTAG |
| CTTCAATGCTATCCAATATTTTGCCAAGTGGCACAAATGGAAGATTTATTAGGTAAC |
| AAAAGTTTTCAAGTACAATTGCCTAATGTTTTTAATGTGAAAAAGTTACTCCAGAAA |
| GAATTTACTAATGATTAAATAAAATCATACTAGCCAATGAATATACTTAACGTGTAA |
| AAAATGAGTTAGAGCCGTAAAAACTATATTCTATGATTAAAAATTCAAACTGGCCA |
| ATAAATACCTATCTAGAAAATTTGGTACCATTCCTTATCCCTTTGAAAAATCATTTTT |
| CCGAAAACGATGTACAAGTTATAGTTTATCTTACTTCTACCTAACCCCCTTACCTAAC |
| TACATACCTATTTAACTTTTATAAGCCCACCATATCAAAAAATAAAATAATATTGTT |
| ATGTATTATATTACTTGACTCGTATTGATCTGACGTGGAAGAGAATCGCAGGATGTA |
| ATGTTTGGTGGGACAGAGACAGTGGCATCTGCGATAGAATGGGCAATGGCAGAGCT |
| TATGAAAGTCCAGAGGATCTTAAAAAGGTACAACAAGAATTAGCTAACGTTGTTG |
| GACTGAATAGGAAAGTTGACGAATCCGATTTTGAAAAATTGACCTACTTAAAATGTT |
| GTTTAAAAGAAACTCTCCGACTTCACCCTCCTATCCCTCTCCTCCTCCACGAAACCGC |
| GGAGGAATCGACAGTCTCTGGCTACTATATTCCAGCAAAATCACATGTTATCATAAA |
| TTCATTTGCAATTGGACGTGACAAAAACTCATGGGAAGATCCTGATAGTTTCAAGCC |
| TAGTAGGTTCCTTAAAGAAGGTGTGCCAGATTTTAAAGGTGGTAATTTTGAATTTTT |
| ACCATTTGGGTCGGGTCGAAGGTCTTGCCCCGGTATGCAACTTGGGCTTTATGCATT |
| AGAAATGGCTGTGGCCCATTTACTTCATTGTTTTACTTGGGAATTACCTGATGGGAT |
| GAAACCAAGTGAGCTAAAAATGGATGATATATTTGGGCTTACTGCTCCATTGGCTAA |
| TCGACTAGTGGCTGTGCCTACTCCACGTTATTATGTAATTATTGAAGGAGAAAAAA |
| GGGTATTTTCTACGTGTATACGAATAGTTATACACAAAATATTGGTTTGCTTGGACA |
| TGTTTATCTTTTTTGTTTGTCTATTAGATGTAATAATAGATGCATATACATAATGG |
| AGAGGACGAAAATAATTGCTTGAAAGGGAAAAGAGAGGAATTGATTATATGGTA |
| TTTGTGTATAGTAGACACTATATATCTCTTTCCTTTTGTTTTTAATATTCATTTGGCT |
| TGCATTGTTAGTTGTAAATGTCCCCTCCTCTTGTTTGTTTCTTCTTTGAAAACATAATT |
| TTAATCAAATAAAGACTTTATCCTTGTTACCTTATTGTATTATAATGGTTCATTTTGA |
| TTGGATCAGTAAGGAGAATTCAGGTAAATAGTCCGACAAATTTACTGTTTAATTTTT |
| CTGATCGTACATAGATTACACATTAATTATACATGATTATATACATACACACACAAA |
| TTTATACACGATTACGGAGGCTATTGTGTTCTTTTATGAGGGAAAAAAAAAATGAAT |

| SEQUENCES |
| --- |
| TTCCATATCCTGTGACACCCAATCGGGTTGCTTCTAACCAATACCCCCTTTGCTTCAG
AAAGCAGGAAAAGGATATTTATCCTTTTGATATTCACTTTTTACCTGTTTAGTTTAGA
AAATCTAGAAATATTTTATTGTTTATTTTTTAATTTATTCTTATTATATTAATTAGGAA
AAATGCATAAGTACTCTCAATCTATACCCAATATTCCAAAGACACACTTATACTATA
CTAAGATCCTATTACTCTCGAACTTATTTTATAAATAATTTTCTACCTCTTTTCGGCCT
ACATGGCACTATCAACCAGATAGCTTGAAAAAATTGTCAACACGCGTTGGGCTCAG
AAGATAGTGCCACGTAGACCGAAAATGGGTAGAAAATTATTTATAAAATAAGTTCG
AGGGGTAATAGGACCTTAGTATAATATAAGTGTGTCTCTGAAATTTCGGGCATATGT
TGGGGGTACTTATGCATTTTCCCTATTCATTATAATCCTCTTTCAATGCATTCTTCAA
AGCATTAAATTTGTTATAACTAAAGGGTAAAGCATGTTCTAGGTTAATATTTAAACAA
GTAAAAATGAACGAAATGAATAATAACAAAAAAAATAGACACATGAAAATGAATG
AAAGAAGTAATAACAAAATAAATCTGATAATGGAGGGTAGGGTTGAGTAGGTCCAA
AGCTGTGGAGGGGACCGTTGAGAAGGTTTGAATTTCGACGCTGAAAATTAAAATAG
AAGGACACGACACTAGTAAAGGAAGGGAAAATAGAGGATCGAATTCTTTTGTGAAA
GTTCAAATAGTTAATTAATGGAGTTATTAATTAGATGTTTCATGTCATTAGTTTTTTC
TTCTTAAATTAGTGTAAGACAAAGGAAAATAGGGAATCAAACTCTTAAGTGAAAGT
TCAAATAATTAATTAATTGAGTTACTAATTAGATTCTTCACGACACTATTTTTTATTC
TTCTTAAATTAAGGTAAGGAAAGAGAAAATAGAAAATCAAACTCTTTCCGTGAAAG
TTCAAATAATTAATTAATTGAGCTACTAATAATTATTTTTCATGGCACTAATTTTTCT
TCTTCTTAAATTAGGTAAGGGTAGGAAAAATGGAGAATAGAACTTTACATGAAAGT
TCAAATAGTTAATCAATTGAGCTACTAATGGATTTTTCATCGCACAAGATTTTCTTCG
ACAGGGAAAATAGAGAACCAAACTCTTAGGTGAAAATTTAAATAGTTAATTAATTG
AGATATTGATTAAATTTTTCACATCTGTTTCTTGAATTAGGGTAATGAAAGAGAAAA
TAGAGAATCGAACCCTCACGTGAAAGTTCAAATAGTTAATTAATTAAGCTACTAGTT
ATTAAATTTTTCACGGCACTAATCATTTTTTTTCTTCTTAAATTAGGGTCAGAGAAGG
GAAAATAGAGAATTGAACCCTTATAAAAGTTCAAATAATAATTAATTATGCTACTAA
TTAGTTTTTTCACGGCACTAGTGGATGCATGGTTCCAAATTAAAGTAAGCCAATTTTT
CAACTCCCCAAAAATGTAGTTGTTGTAGAAAGTTGACACTAATTGGAAGACGTACG
AAAGCAACCTTAATTGAGTTGAATATGTGATGCATTAATCATAGGGAGTTTAATTAC
GTTGGATAATCTTGAAAAGTTTAATTTAGGGATATTAAATGACAAAATTTCTTTTTTG
ACATATAAGAATA |

SEQ ID No: 79
>Apple_XP_008372753.1
AGCCAATTAGGGTTTTACCCAAAAATTAAAAAGAAACCCACAAAATAAAT
CAAGATTTGTTTTCCAAAGAAGCACCATCATAATTTGACTAGTAATTTAAGGAACCA
ATATGTAACTCACACATATATATATGATTCAATAAAAATATAAGAGACTAAAAAGA
GTGCCCAACTGATAACTAAAACTTGATTTACATGATATTTTTTAGGAAACAAATCA
ACAATCGCATGAGATTCGATCAATTTGGTGAATATATTTATATTTGGGTGGAGAGGA
CCAATATGCCTCACATGTATGTGACTAGTTCGACGAAAGTCCACAATGGCAGCAGCT
CTTCTTGTTGCCTTCCAGCCATGGTTGAACTTTAGAACCATTAATTTATTTTTCTCAG
GAAAACATTAATAAAAAAATGTCAACACATATTATCCAAGATTCGTCTGTAAGTTAT
TTTGTCTAAATTGCAAGAGCTGAACTCATTTCTTGTAAGTTTAGTTTTATTTATTAGT
CCTTTTATTGAAGGAATTTCAGATAATCAATTCCATTTGCTGTACGAAATCTCTGTTA
ATTAACTTAATTACATGTATATCTCTTTCGTGTTAATCAGTTTAAGATGTACTTAGGT
TTCCAAGACATATAAATTATTTCAAGGCGCCACATAAGGTATATCTTATAACCAAAC
CATGTTTTCTTGTAATCATGTATATGCATAATAATATTTATTTTGACAACATGATAT
GATGTCTATAACGTAAAAGTTAATATTGTTATAACAATAATGATGTCATTATGTGTT
ATGTAACTAAAATCTTACTATTATTGTGTAACCTTAGACTATAAATCTTAACGATTAT
GGTGTAATTAACCTTATATTTCTTGTAGTCCAGACGTTGAATGTTAACATTATTTTAT
AACACCAAATGTGAAGGTAAAGAGTCAAAAGTGAATACTGATAAATGTGAGATTTC
TTGACGTCTATTTTTAATAACTTGCGTCTATAAACGCTATACTATAACAAGACATTCA
TAACCATCAAACATTAGTGTAACAATATCATTCCATAACCTCGATCACTATTTATGT
AACGTTGAATAGTAAATGACAATTATAATATAATTGTTGTTATACAAATGGTGGCGT
AGAAATTTGCTTTATTAATTTGGGACTTATTTGTAAAAATATCAGTTGTTTTACTTCA
GACAAAGTCAAATTGAAGCAATTTTGTGACGTTGTTCCTATGAGTAGACTCTATCGT
TCCTATGAGGAGACTCTACGAACTCTCTCATTTCTTGTTTGTTTTGGGTGGAGCGTCT
TACTATTAACTAATTAATACTCCCAGTCCACACTTCATATATTTATAATCAAATTCYT
ACGTCTCTACTATGATTGGATGAAAGAAATAAACTTAGAATTTAGATAAAAATCAG
AATTTATAAATTGATATACACCAATTCGCTTGTTTGAATTTATAAACATAGAAATTTA
GAATTTCAGCGTGAAAGAAAAACTTGGAATTTAGGACCTCCAATTCCCAAGTTTAAA
TTCCATGTAAATAGGTATCATTTCTCAATTTCTATGATTGAGAGTTTAAAATTAACAA
AGTTCATTCTCAATTYYATTGTTCTTTTAGGTTAATCAAATAAGAAAATTCATAAATT
TTAGAAAATAAAATCTCGTCATTTTAAAATTTCTTAATAACTTTAAATTTCTCCATTC
AAACATAGTATAAACGTCGAAACGGCTCGAATTTGGATAATGAGAAAAAAAGGGA
TTCAATCCAAAAATCCCCAAACTTGGTTTCTTGTCCCATACTATTTCTTTTCTTTTCCA
ACTTTCATACCATAAAAATACTATAAACAAAACTAAACAATCTCAATTGTTTTTAAA
TAGTTTATTTCTCGATAGCCTGACCAAATTCCACTGTAGCACTAAAAAAATAAATAA
ATAATCCAACAGTTGCACAAACTTTGTATATAAAAGGCACCATAATATCTCTTCCAA
CTTAGCAACATTTGGAGGTTGCCCTGCTACTTCTGCTAATCATACCCACGAAAAAG
GTAAAAACAAAAACAAAAGAAACACACACAATATGGATTATCTTCTGCAGTCCTT
GCAACCCTTACAATCCATGACACCACTCTTGCTCATAATCCCACTCCTATTTCTCCTC
CCTCTAATTTTCCGTTTCCGGCGACCACCACCATACCCGCCCGGCCCCAAAGGCCTA
CCCCTTATTGGCAACATGTTATTGATGGACCAACTAACTCACCGGGGCCTCGCCAAG
CTGGCCAAGAAATACGGCGGCATATTCCACCTCCGCATGGGGTTTTTTACACATGGT
TGCGATTTCCAACCCTGACGTGGCACGACAAGTCCTTCAAGTCCAAGACAACATCTT
CTCCAACCGCCCGGCCACCATCGCCATCAGCTACCTCACCTACGACCGCGCTGACAT

SEQUENCES

```
GGCCTTCGCGCACTACGGGCCCTTCTGGCGCCAGATGCGTAAGCTCTGCGTCATGAA
GCTCTTTAGTCGCAAACGCGCCGAGTCCTGGGAGTCTGTCAGGGATGAAGTGGACTC
ATCGGTTAGGACCGTCACAGTTCATGTTGGTTCGGCTGTAAACATCGGAGAGTTGGT
TTTTTCGCTCACGAAAAATATTATTTATCGGGCGGCGTTCGGGACGAGCTCTCAGGA
AGGGCAGGATGAGTTTATTGGGATACTGCAGGAATTTTCCAAATTGTTTGGAGCTTT
TAATATTGCTGATTTTATTCCTAGCCTGGGGTGGGTTGATCCTCAGGGGCTAAACAA
TAGACTCGCTAAGGCTCGTGAGTCCTTGGATCGGTTCATTGACACCATCATAGATGA
TCACATGGAGAAGAAAAGGAATGGTAAGGGAGTGAGTGACGGTGAAACGGACATG
GTGGATGAGTTGTTGGCTTTTTACAGTGAAGAAGCTAAAGTATATGAATCTGAAGAT
AATTTGCAAAACGCCATCAAACTTACTAGGGATAACATCAAGGCCATCATCATGGTA
AATAACTATTACACAATTTCATATCACATATTTATATTATAACCCCACAGGTTGAAT
GTCTATGTAACCTGTTTTCTTGGACTAAACTTTTGGCTAATTTTTCTTTTTATCTGAT
CAGATATATTAATTGCGTATTGAGACAATGAAGATAGAAAGTCTAACATATTATATT
ATTTTGAAACTGATTGTTTAAATTGACGATCTGACTAGGTATATAACATGCTGTATAT
GCAAATTAATAAGCTAATTATATATGCTACGTACTTTCAGGACGTAATGTTTGGCGG
GACGGRGACTGTGGCGTCGGCAATAGAGTGGGCCATGTCGGAGCTGATGAAGAGCC
CGGAGGACCTAAAGAGGGTCCAACAAGAACTTGCTGACGTGGTGGGTCTAGACCGT
CGACCTGAAGAGACCGACTTCGAGAAGTTGACATACCTAAAATGTGCCCTAAAAGA
GACACTACGACTCCACCCACCAATTCCACTACTCCTCCACGAGACCTCGGAGGACGC
TGTAGTAGCCGGCTACCGCATTCCCAAAAGATCGCGTGTGATGATCAACGCGTGGGC
CATTGGACGTGACAAGGACTCGTGGGAGGACGCCGAGTCCTTCAAGCCCTCGAGGT
TTTTGAAAGAAGGTGTGCCTGACTTTAAGGGGAGTAACTTCGAGTTCATTCCGTTCG
GGTCCGGTCGGAGGTCGTGCCCGGGCATGCAACTAGGGTTGTACGCGCTGGAGATG
GCGGTGGCACACTTGCTTCATTGTTTTACGTGGGAGTTGCCTGATGGTATGAAACCT
AGTGAGCTCGACATGAACGACGTGTTTGGACTCACCGCTCCGAGAGCGAGTCGACT
CATCGCCGTACCGAGTAAAAGGGTGGTTTGTCCACTCTGATGGTGATGAAAAAACA
GAGAGAGAAACAGTGGTGGAATTTGTTTGGAGTGTAATGATACTGTGAAAACTGCA
CAGGTAAATTGCAAGCGTTTTCTTATTGTTCTTTTGAAAAACAAAATAATTACAAAG
AGAACATGAACAGTTGTGAGGGAATTTTTWATTCACTCTCTTTGTGTATATAGACAC
TCTCTTTTGTTTTGTTTAATATGTATGCAAATTTATCGTTAATTTCCTKKTTTTTTCCTT
TTTGTTTTKTTATTATTGTATTGAAATAAAAATATAATGGCTGAGTTACAAAAATTAT
TTGTCATGGTGGAAAAATTGATGGACTGCTTATGTTACGATTTCAATTTGTTTTCTGG
GTCGGTGGCGCAATAGTAGAATTATTTTGTTTAAAAATGAATGAATAAAGATTAAAT
AAAATTAGCTCTTGAACAACGGTAGAATAATGTTAAATCATGCTTACGATAGAAGTA
GCTCACGCTGTCCTCAGCAGTTGTGAAAATTGACATTTAAGTTGACTGTTGCATGTC
ACTTATATATTTATTTGTGGTTAAAATTGTTACATAAAAAATATGAAGAGTAATGCT
GTGGAGGTTAAATTTATAGACTAAAATTGCAAACTAAATTATGTGTCACTAATAAGA
AATTAGCACTTTTATCAACGTTTAAGTAATAATTCAATCATCAATATCCATATCATTT
AATTTACAAAACTTAGTCTACAAATTTAATCTCCCTAGCATTACTCAAAAGTGAATG
ATTGTGAAAATGAATTAAGGTTGGTAGGACTTTGACATATAAATCTAAATATAATTA
AGAAGGCTCTAGGGTAGTGCTGTTCACACACCTTTTTTWACTTCTCTCACTCTTATTA
ATTTTGTTTATTGATCTTCTTCAATTAATTCAATCCGGCGACCGAAAATTGAAAATAG
TATGTGAGAAGTAAAAATTAGTGTGTAAGTAGCACTACCCGTGGCTCTATATATGGT
GCCCAAGTCAGGTTGATGCATTTTGGTGGCTCCATATTTTTGCAAGACAAGTGCCCT
AGCTAGTGACCCGAAGAGATCTTGTTTATGAACTAGTTGTATACAACTGTTTGTTAT
CTCTCATCATGTTAAAAAGTTAATTAATATATAGACAAAATTATCTGTAACATACTA
GTAATTAAGAAAGTTTGTAACCAATTGTGTATAATTATGTATCTACCTTAAATGTGG
TATAAGACCAGAAGAAGTACCGTATATCATATAACATACTTGATGGTGCATTCCAAC
CGATTTATGTGTGGAGGAAGTGTCGTAAATGCCTTGTTGAGCTGCATCAGCATCTGT
TTGTGTGCGCGCGCGCGTGAGAGAGAGAGAGAGAGAGAGAGAGAGAGAGAGAGAG
AGAGAGAGAGAGAGAGAGAGAGAGAGAGAGAGAGAGAATGAATATATT
GAGTTTAGGTGGGCAGTGAAAAGTGAAGTGAGGAGGACGTGAGGCCTTTTCCTTGT
ACTATGAAGAGGTAAGTGGAGGAGCATGCCGGAGAAATCGAAGGGGAAGTTGA
GCAGAGTTTGGTAGGAGAAGGATTGCAAGAAGAAATTAATTTTGATAGAAAAGAGA
TTAATGTTAATAGAAAAGAAAATAATTTAATAAAAATTATAGTATTTTTTATTTGTA
ATCTAATACTACATCAAATGCTTCACTAAGTCAATCTAATTAAGTCTAGTCCTTGAA
GCTAATTCAGTCCGAAACAGTCCGGTGCAACAAATGCCCTCTATGTGTATCAATGAT
CATGAATCAAATAATATGTATAAAAAATATATAAATATGTTGTGATTTAGGGACA
CGTTTGTGACACATTTTGACACACATTTTTATGGAACTCACTCTGTAATGTATTTTAG
GGATCCAGCCGTCTATCTTTTATGTCTTAATTTTTTTATGTCTTATCTTAAAGATAAT
GTCTACCAAAAACCACCTAAATTTGAAACCATATGATTGTTGATTGAATTTAGTGTT
TCATTGTAGAACAATATTCGTTTATTTTCTTCCCTACAAATAAATGTCTTAATAGTCT
TGGATTTGCATAATTTTTTATAAGAATGATTTATAAATGATATAATAAAATATAGAC
AATTCTGATCGTCGAAATACATATAAATTAGACTCTACGTACTATAAAAATAGATGT
CAAAATATATGCCTTCGTGTATTGTAACTCTCTACATATGTGTGTGAAAGCAGAT
TGTGTTTATGTAAGTAAGAGAGAGCTGGAAAGGGACGCCATCCGATATTTTCCATCC
T
```

SEQ ID No: 80
>Apple_XP_008337913.1
```
AACCTACAAAATAAATCAATCAAGATTTGTTTTCCAAATAAGCACTATCTT
ATTTTGAGTCATAATTTTGGTAGCATAATAAACAATATATTGAAAGTATAATATAAT
TTATATTTTAAGATATAATATAATTTTATTAATACGTACAGCTTAGAAATTAGTTTAT
AAATATTCAATTGCTTTACTTTAGACAAAGTCAAATTGAAGCAATTTTCTGGGGTAA
TGTTAGGATTCTTTATAAATTAAATTTTGTAAACTAAATGAGATGGTTGTTAATGATT
AAATTATTATTTAAGTATTGATTACCATACTTATTTCTTATTGATGCACTTCATTTA
ATTTAAAATTTTAGTCTCCCTATCATTATCTGAATGGTCGTTTTGTTAGTAAATGCA
```

| SEQUENCES |
|---|
| ACCAACTCTCTTATTTCTTCGAGTTTAGAATATTTGTATTTTTTACGTATTAATCAATA |
| GTACTATTCTCATTACATTTTTCATACCAGATTTTGTAAACCTCTCTAATAAAGTGAG |
| ACTCACATGTGTTGATGGGTTAATACTTCTACTAAAAAAGTAATGTTAGGAGACCAA |
| ATTTTTTAAACTGAATTGCAAATCAAATGACGTGTCACCAATAAAAAATAAACATGT |
| TAATCGACACTTAATTAATAATCCAATCATTTACAACCACATCATTTAATTTGCAAAT |
| TTGGTTTAAAAAAATTGGTTTCTCCAATGGTGGCTTATAACCTAAATTTCCCCTYCCC |
| CCCCCCCACCCCAAAATCCACTCCAACCCAAAACATAAACCAGACCTAAAACCTAA |
| AACTTAAAATGAAGGTAAATATAGGTCACAAATTTAGCCTACAAAAGCCGCTGAGA |
| CCCACGGATGAGAGTGAAAAGTGAGCATTGTCCTGTAGCCAACTGCTACTTTTCTTC |
| ATCGGGTGGTGGTGGTAATTGGACCGTTGGTTAATCCAACGGTCCACATTCAATTTT |
| TTTTATATTTATATATTTATTGAATCCAACGGCTTAAATCGAATATAATCAAATCTAA |
| CAGTAAAAGAAAAGATCTAACGGTCCAAATTTAAATCCAATGGCTAGAATAATCTT |
| AAAATTTATCGGAATTTAAATATTTTTTTCCAACGGCTAGAATAATTTTTTTTTTTTTA |
| AGTTTATGTGGTTTATCATGATTTTCATGTATTGATTTAGTGATTTTTCAAAATTTATC |
| GGAATTTAAATATTTTTAGGTTAAAATGTTCATAAAATTAATTTAGGATAGTCTACA |
| TAATTTTTAAAAAAAAAAATAGCCTTAATTCATTTTTTGATAATCTAGGGCTAAAAT |
| TTTAGGCCAAAAGGGTTAGAGTAGAAAAGCTGTTTCTGGGCTAAAACCTAAATTTTC |
| TGGGCTAAATATTTTTAGGTTTTAGGTCAGGATTGGAGATGATCTAACATTACTCCT |
| ACTAAAAATATGGTACAAATATAGTATGAAAAATGCTATAAGTGTAGTATGACTTG |
| GTATTTATACCAACAGGACCATCTCTGAATCCTTTGGTGAGGATCTTGAGGATCATT |
| GAATCGTGTCTGTTTATCGTACATCGTGCAGTTAATTTTTGTCAAGTACTGTTTGTGT |
| TTAATTTTAAATGAAAATATTTAAATAATTTCTGACCGCATGATGTACGATAAACA |
| GACAAGATCGACGGATCCTTGGGATCCTCACAAAAGAATCTCGCGAGGATCCGGA |
| TTCGTATTTATATGCCAAAGCGGACTCGGACCTTTGGATAATGATCAGGGAAAATGA |
| CAATTCAAAAAATGGGTAAACTTCTTATCTCATCCATAGCACTATTACTTTTTCTTTA |
| CAGACAAAATACTCTAACTTTCAAACCATACAATTTTAAAAACAAAAAAGAGAAAA |
| CTCCTTGAATTAGTTCAATTCAAGATAGCATGACCCAATGAAACAGCAACACCAAA |
| AAATTAAAAATATATAAATCAAACAGTAGCACAAATTTTGCATATAAAAGGCACCA |
| CAATATCTCTTCCAACTTAGCAACATTTTGAGTTGCCCTTAAAATCCACACACTATGG |
| ATTCTCTTCTGCAATCCTTGCAACCCTTAAAATCCATGACACCACTCGTGTTCATAAT |
| CCCACTCCTATTCCTCCTCCCTCTAATTTTCTGTTTCCGGCGACGACCACCGTACCCG |
| CCGGGCCCCAAAGGCCTACCCCTCTTTGGCAACATGTTAATGATGGACCAACTAACC |
| CACCGGGGCCTCGCCAAGCTGGCCAAGCAATACGGCGGCATATTCCACCTCCGCAT |
| GGGGTTTTTACACATGGTTGCCATTTCCAACCCTGACGTGGCACGACAAGTCCTCCA |
| AGTCCAAGACAACATCTTCTCCAACCGCCCGGCCACCATCGCCATCAGCTACCTCAC |
| CTACGACCGCGCAGACATGGCCTTCGCGCACTACGGGCCCTTCTGGCGCCAGATGCG |
| TAAGCTCTGCGTCATGAAGATTTTTAGTCGCAAACGCGCCGAGTCGTGGGARTCTGT |
| TAGGGACGAAGTGGACACGGCGGTTAGGACCGTCACAGTTCATGTTGGTTCGGCTGT |
| AAACATCGGAGAGTTGGTTTTTTCGCTCACGAAAATATTATTTATCGGGCGGCGTT |
| CGGTACGAGCTCGCAGGAGGGGCAGGATGAGTTTATTGGGATACTGCAGGAATTCT |
| CCAAGTTGTTTGGAGCTTTTAATATTGCTGATTTTATTCCCAGCCTAGGGTGGGTTGA |
| TCCTCAGGGGCTAAACAATAGACTCGCTAAGGCTCGTGAGTCGTTGGATCGGTTTAT |
| TGACACCATCATAGACGATCACATGGAGAAGAAGAAGAAGAACAATAAGGGATTG |
| AATGATGGTGAGACGGACATGGTGGATGATTTGTTGGCTTTTTATAGTGAAGAAGCT |
| AAAGTAAATGAATCTGAAGATAATTTGCAAAACGCCATCAAACTTACTAGGGATAA |
| CATCAAGGCCATCATCATGGTATATAACTATTACACATTTTTATATCAGATATTATAA |
| CCCCGCATTCAGGTTGCATGTCTCTGTAACCTGTATTCTTGAACTAAACTTTTGGTTA |
| ATTTATTCTTTTTATCTGATCAGATATAATAAATTGTGTTGATTGAGATTATGAAGAT |
| AGAAAGTCTAACATATTTAACTTTAAAAATTAATAATAGTTGACGATATCTGA |
| CTACATAACATGTTGTATATGCAAATTAGTAAGCTAATTGTATATGTTATGTACATG |
| CAGGACGTAATGTTTGGCGGGACGGAGACTGTGGCGTCGGCAATAGAGTGGGCCAT |
| GTCGGAGCTGATGAAGAACCCGGAGGATCTAAAGAGGGTCCAACAAGAACTTTTAA |
| ATGTGGTGGGTCTAGACCGTCGACCTGAAGAGGCCGACTTCGAGAAGTTGACTTACC |
| TAAAATGTGCCCTGAAAGAGACACTGCGACTCCACCCGCCAATTCCTCTACTCCTCC |
| ACGAGACCTCGGAGGACGCTGTAGTAGCTGGCTACCACATTCCCAAAAAATCGCGC |
| GTGATGATTAACGCGTGGGCCATTGGGCGTGACAAGGACTCGTGGGAAGACCCTGA |
| ATCCTTCAAGCCCTCTAGGTTTCTGAAAGAAGGTGTGCCTGACTTTAAGGGGAGTAA |
| TTTCGAGTTCATTCCGTTCGGGTCCGGTCGGAGGTCGTGCCCGGGAATGCAGCTAGG |
| GTTGTACGCTCTGGAGATGGCGGTGGCACACATGCTTCATTGTTTTACATGGGAGTT |
| GCCTGATGGGATGAAACCTAGTGAGCTTGACATGAACGACGTGTTTGGACTCACCGC |
| TCCGAGAGCGAGTCGACTCGTCGCCGTACCGAGTAAAAGGGTGGTTTGTCCACTCTG |
| ATGGCGATGAAAAAACAGAGTTGGATTGAGGAGAAAGAAACAGTGTGCAACATGTT |
| TGGAGTGCAATGTCAAAGTATACATACAGTAAAAACGGCAGGTAAATTGCACTTGT |
| TTTTAATTGTTCTTTTGAAAAACAAAATAATTACAAAGAGACTTTAAAAAGTTTGTG |
| GGACTTTTTATTTCTCTCTTTGTGTATATAGACAGTCTCTTGTTTTGTTTAATATGT |
| AAGCAAATTTATCTTTAATTTCCTTTTTTTTTGTTTTGTTATTATTGTATTGAAATAA |
| AATTAGTGGATGAGTTGCAAAATTATTTGTCATGGTGTAAGACCATCTCCAACCTTT |
| GGATTAAAACCTAAATTTTTAGTCCAGAAAATTTAGAGTTTAACTGAGAAACAACT |
| TTTTTGCTCAAACCCTTGTAGATTAAAGTTTTAGTCCCAGATTATTAAATAATGAATA |
| TAGGCTCTTTTTTTTAAAGTTACTTTAAAAAAAAAATTATGTAGACTATCCTAATCTA |
| ATTTTATGAACATTTTAACCTAAAAATATTTKGATTCCGACAAATATTAAAAAATCA |
| CTAACCGACACCATGAAACTTGTGAAAGAATTTTTTTTAATTACTTTAGCCGTTAGCT |
| TTATATTTGGACCATTCGAATTTTTTTATTCTTTTACCATTGGATTTCATTAAATTAGA |
| TCTTAACCGTTTAATTCAATAAATTTATAAATATAAAACTAAAAAAAAWWATACATA |
| TATAGTGAGCCAGTCTTTCTAACTCATGGGGAATCTTGAGCTAAATTTAGCCCATAA |
| ATGAGTTTTGAGTTTTAACTCATATTTGCCCTAAGACCATCTCCAATGGTGGCTTATA |
| ACCTAAATTTTCCCCTTCCCCCCCCCCAAATCCACTCCAACCCAAAACCTAAACCAA |

| SEQUENCES |
|---|
| ACCTAAAACCTAAAACTTAAAATGAAGGTAAATATAGGTCACAAATTTAGCCCACA |
| AAAGCTGCTGGGACCCACGGATGAGAGTGAAAAGTGGGCCTTGTCCTGTAGCCAAC |
| GGCTACTTTTCTTCATCGGGTGGTGGTGGTAATTGGACCGTTGGTTAATCCAACAAT |
| CCACATTCAATTATTTTTTGTTTTATATTTATATATTTATTGAATCCAACGGCTTAAA |
| TAGAATATAATCAAATCCGGTAAAAAAAAAGATCTAACGGTCCAAATTTAAATCC |
| AATGGCCAGAATAATCTTAAAATTTATCGGAATTTAAATATTTTTTCCAACGGCTA |
| GAATAATTTTTTTTTTTAAGTTTATGTGGTTTATCATGATTTTCATGTATTGATTTAG |
| TAATTTTTCAAAATTTATCGGAATTTAAATATTTTTAAGATAGTCTACATAATTTTTT |
| TTTTAAAGTTAATTTAAAAAAATTAGCCTTAATTCATTTTTTGATAATCTGGGGCTAA |
| AATTTTAGGCCAAAAGGGTTGGAGTAGAAAAGCTGTTTCTGGGCTAAAACTTAAATT |
| TTATGGGCTAAATATTTTTAGGTTTTAGGTCAGGATTGGAGATGGTCTAAGAGTTGG |
| AGCAAGTTGGGGTAAATTTGTAACTTAAAATTTGAGCTTTACTCCAAGGGAGTAGGT |
| CTAATAATTGATGGACTGCTTATGTTACGATTTCAATTTGTTTTTTTTTTTTTTTTTT |
| GTGGTCGGTAGGAATGGTAGATTTATGTACAGCTGTGCTTACGATATAAGTAGCTCA |
| TACTGTCCTCAGCAGCTCTGAAAACAGACACTAATTGACTCATTTCGATTATACTTAT |
| ATAGTGGTTGAATTTCTTATATTAAAGATGTGATATTGTGAGGATGGTGAGAATGAA |
| TGAATGTTGGTGAGGACGTTGACATATAAAGCTAAATATAATTTAGAAGGCTGTATA |
| TATGGTGCCCAAGTCAGATCAATGTCTTTTGGTGGCTCCATATTTGCAAGAAAAGTG |
| CGCCTTTTGTAAATACTATTTATTTGTTATATAAGCGTGTCCTTGCTAGCGACCCGAA |
| GAGATCTTGTTTACGACTAGCTGTGTACAACTATGCGTTATCTTATACATTTATACAA |
| CTGTGCACACGTATAGAATTGTCCATATATAATTAGTAAAAGAATTTCTTGTTTGTA |
| AAATTAGTTTTGTACAACTATATGTGATCTGTGTAKATGATCAGAAGAAGTACTGCA |
| AAGCATATATATAGGACAGTGCACTAGTTAACCTACGCGTGCAGGAAATGTTGCAG |
| TGACTGCCCTTGTTGAGTTGCATCAGCATGTGTGTACTTTGTACAACCGAGAGAGAG |
| AGAGAGAGAGAGAGA |

SEQ ID No: 81
>Apple_XP_008391587.1
ACATCTCAAAGCCCAACCCCAAGGGTGAGCCCAAATTTAGTCTCCAGGCC
TATTACTCTAATCAATTTCTATAAARAACAAAGCCTTGTAAAGTAATAAAATCTTTT
GGGAATGACCAATGTGGGACAAAGAAATTTCTACTCAAACTACTCAAATTTCCAAC
AATACCCCACATTTGAGTTGAAATTTCATTCAAACTYCAWCAATTACCCCACATTTG
AATGCAAATGGATGACTAGGCTGCYTAWAMCTGAGAGWGAATAGACATRATATGC
ATCGAGTGAAGTGTCTTTTGGACTTGAACTTACACAGATCATGTCTGYCAYACGTAA
ATTCATACGMTTGTGTTCATTTTGGCCCTGAACAGATCCCGGATTTCGTAGGAGCTT
TAGAGAATTTAGCCATGTCATTTCTCATAAATGTGGGCCCTAAACCCCAAGGCCCAT
CTTTTGACAATAAATATATATTAATTACCAATTAATTAGTATACCCCAAAGTCCAAC
CCCAAGGGTGAGCCTAATTTTAATCTCCAGGCCTATTACTCAAATCACTTTTTATAAA
AGACAAAGCCTTATAAAGTRATAAAATCTTTTGGGAATGGCCAATGTGGGACAAAG
AAATTTCTACTCAAACTACTCAAATTTCCAATAGACAGAGAATCAGTTTGTTGAGGT
TGTTTAGCCCCCTTTTCTTCACTTAACGACACACTAGACAATCCACCACTTGCCTGTT
TATCCCCATTGAATTACCGAAAATAAAAATAAAAGGTCAGAGTTTCACTTACATAGC
AAATTAATACATATATTCAAGTGGCCTGGGGACAATGTGGACAAGGGATATATTCA
AGTCGTCATCTTCTATGCCCAACCATTGCGCCTTCGTAAGTTGGTGCATAAAGGATA
CACTTGTTCAGCATAGCTTTCATTGACTGATCTGAGAACTCGTGTCGGAAAATTTTG
ACATTTAGGGGTACAAGGTATGATCACAGAAAACTAGAGTTCTCCCAGTGGCGAGA
GAAACTCTGCAATCCATCATAAGTGAAGTAGTCTATCTCTCTCATCATGTGTCACCA
GGGGCTCAAAGTAAGGGCGACTGGGATTTATCAGTAACCATGCATTGATACAATAT
CATTATTCCTCTTTTGCCTCTCAAATATAGCAAAAGGGAAGCAAAACAAGGTCAACT
GTGAATCAACATTTTCTTGCTCCATTCAGTTTACTAATCGTTCGTTCTAACATCAAAT
TGCCATGACCATAGCAGCTAAAACCCTGTAACAGATCTAGCATCACACTGCCGTAA
AAAGAATAGTGATCTCTGAGTTTCTGTATCTCATCGATAACAAAATACCTACAATCG
TATGTGTCAAATATTTATTTTATTAATATATTCGGTCCCATAGTTCTTGGGAGCAGCC
TCTCCATAAATGGGGGTAAGGCTATCCGACATTCACCTCTCCCAGACCCTGCGTAAA
GCGGGAGCCTTGTCACTGGATACGACCTATTCGGTCCCATAGTTACATTAATTATT
AAAAAATAATTAAAAATCAATTTTAATCCTATTGGTTGTCAATGAGACTCATGAATT
AAACAATTAAATTAAAGGCATTTGACTCCATCTTTATTTGCGGTAAAAAATGTCATA
TATGACATCTCCTTTAGAGAATACCGTGATGTCTTTTAATCTTAGTTGACGTATTTGA
CATCTCTTTTACATGGTAAGAATTCAAATTATTCTTCCCTCTTTTGTCGAAATTCAA
TTAATTCCTTAATTAACTGGGGTATAATCTGTTTCCAGACAAGTGGATCCAAAATTC
CCACTGGCAGTATACACAAAACAACTCGTGACGTTTGCAAGATAAAATACATAGCA
GATATCACCACCAAGTCACCAGTTATTACTTGCCACTTTAGGGCTGCAGATCCCTTA
TTAATTATATAAAGAACTCTCATAGTTTTATATGAACCTCACCAACCCCATTTTCCCA
ACACAACCAAAGCCATGGAACTCCTTCACCAAGCTCTTCAATCCTTGCAATCTTCAC
CCATGTTGCTTATTCTTCTTCTTCTCCTCATCATTTCCTTTATTTTTCTGTTTAATT
CGCGCCGGAAACCCCATATCCGCCAGGTCCAAAAGGGTGGCCCATCATCGGTAAC
ATGCTCATGACGACCAACTTACCCACCGTGGCCTGGCCCATTTGGCCAAGCAATAT
GGCGGTCTCCTCCATCTCCAGATGGGGTCATACATGTTATGCCGTATCAACTCCT
GATATGGCACGCGAAATCCTCCAATCCCAAGACAGCTTATTTGCCAACCGGCCAGCC
AATGTTGCCATATCTTACTTGACCTATGATCGGGCAGACATGGCCTTTGCCAACTAC
GGCCCGTTCTGGCGTCGCATGCGCAAAATTTGCGTCATAAATCTATTTAGCCGAAAA
CGGGCTGAGTCATGGGCTTCGGTGCGCGAGGAAGTCGATGAGATGGTCCAAACCGT
GGCGGGGAAAACCGGCTCGCCGGTGAATATCGGGCAGTTGGTTTTCGCTCTAACTAG
GAACATAACATATCGGGCGGCTTTTGGGTCAAGCTCACATGAAGGGCAAGGCGAAT
TTGTGCAGATTTTGCAAGAATTTTCAAAGCTTTTTGGAGCTTTTAACATGCAGGATTT
TCTACCTTGGTTGGGTTGGGTTCATGCACAGGGTTTTCAGGACAGAATGGCTAGGGC
ACGTAAATCACTAGACGTTTTCATCGACAAGATCATCGACGACCACATGGCTAAGA

```
GGAAAGCAAACATGGAGAAGGATGACAGTGAGGCTGCTGATACAGATATGGTGGA
CGAATTGATAGCTTACTTTAGTGATGATGCTGGAAAGGAAGGTGACGACCCCAATTC
TGGCTTCAAGCTCACCAGAGACAATATCAAAGCACTTATTATGGTATGTAAATTTGA
CAATTAATATTTTCTTAATACGTTATATTTGTTGGTGAATAGTCACACATCAGAGAA
AAACAAAAATAATATATAATTTTTATATTTGGGACATAAACTTCTAATATCATCGAG
ATTTTCCAATGATAAAATTCAACACATAGCAATAAGTGGTATGCACTTTATTAATTTT
TAAGAAACAAATCTGATTTTAAGTATTTGTTGTTAACTATTTTGGTAAGGAATTAGG
AGAGAAAACTATTCTGATAAGGAATTCATGTACGTAACTATTACTATATTTATCATT
TCCGATTGTATATCGATTGATTTAGTACTAAATAATACGATTATCCCATATATACGTA
GGATGTGATGTTTGGTGGAACAGAAACGGTTGCATCAGTGATCGAATGGACAATGG
CAGAGCTGATGAAGAGCCCAGAAGATCTCAAAAGAGTACAACAAGAGCTCACCGAT
GTGGTTGGATTGAACCGTAGGCTCCAGGAAACCGACCTCGAAAACCTAACCTACCT
CAAATGCGCAGTCAAAGAATCCCTCCGTCTCCACCCGCCAATCCCTCTCCTCCTACA
CGAGACCGTGGAAGACACCTCTGTGGCTGGCTACTCGTTCCCAGCTGGGTCACGGGT
TTGGATCAATGCGTGGGCTATTGCTCGTGACCCGACTGCATGGGACGAGCCAGAAA
CATTCAAACCCTCGAGGTTTCTGGAAGATAGCTCGCCTGATTTCAAAGGGAGCAACT
TCGAGTTTATTCCTTTTGGGTCTGGTCGGAGGTCGTGCCCGGGAATGGCGTTGGGGC
TGTATGGGTTGGAGATGGCTGTGGCTCATCTGCTTCATTGTTTTGCATGGGAGTTGCC
GGGTGGGATGAAGCCTAGTGAGCTTGACATGAATGATGTGTTTGGACTGACTGCACC
AAAAGCGGTTCAGCTTGTTGCTGTGCCAACTTACAGGTTGAATTGCCCCCTTTGAAT
TAATAGTTTCAAGTAGACGAGGAGACGATGATGATGAAATATTACTTGGTTTTAAAT
CAGTGATCGATGAGTCAATTTCTCTACGTAAAGGTACCTTAACTAATAAGGGTTTGT
TATGTTCTTGGTCTCTCTTTACTAATTGGATAATACTATTGCTTTCCCCCATGGGGA
TGAGCTTATTATTCCTCTATTGCAAATAACAATATCTTCAACATAGAAATTTCATAAT
CGGAACAGTCCAATATCTTAATCTTCATTTGAAGATCATCCTTACAAAAAATAATTT
GATTTTGTGATCGGTTCGTCATCCAAATGTATCAGTAAATCAACGGTTCATCATGAA
TATGCTACTTGATACCTACACTTATGATTTATTTGATACATTTGAATGGCTAAACAAT
CACGTCAAATTATTTTTTTGGAGGGATGATCTTAAAATGAAGATTAAGATATTGAAT
GGTTCTAATTATAAAAAAATCTACGTTAAAGATATGTTATTTGCAACTGGAGAAATG
ACCTCATCTCCCATGGAGAGTATGTAAGCAGTATCCATTATTGTAATAATCATTTTTA
ATTTTGTGATCGATATAATATCACTATGTTGTTAATAGTTAACATAAATATATGCGTA
GTTGTTTGTTAACCTTTGTTGGCTTTCTGTCCTTTGTGGCTCGGCCGTGTATCTTTTAG
TCAGTTTTCCGAAAGACAAAAAGGGAAGAGATCCTATCCGGATCTCTCCCACCAAAT
TCTAGGGATTCGAAGATCCGGACTCTTAAAATTGAATTCAATGGCCACAAACAGAG
GATCTCTCTAAAAGTTATAATAATTACAATAGTTGGATCAAATTTCAAAGGTTTGGA
TCTTCGGATCCCTAGGACTTGGTAGGAGAGATCCGGAAGGGATCTCTTCCCTACAAA
ACAAGTGGGGATGTACTTTTAATGTTGGACTGTTAAAGTCCTGGAAAAACATCTTTT
GTCAAACTATATAGCAAAAATAGTAGTAAGCTAAGATGCTTATGGTGTTAGATTATG
GATCGAGGTTATTGATCAAGATGAATCTTTCCTAAATTTATACCAAATTTATAATCTC
ACAACATAATTTGATGAACTCGATATGCAATATTGATCACACAAAGAGTTCATATAG
AATATTGGTTTATATCATAAAAAATTAAATTTGTAGGGTTCGTAAACTGTTCTATTAG
GTAGTAGTAACATATTAACTTGATATTGTGATGATACAAGGCTAAAATTAATAGTAT
TGTTATCAACTAACTATTGATCTAGTAATTTTTTTTCTTCCCTAATGTTGAAATAAAC
GTCTTGAGCTCGATTCCTCTCTTTTATACAAAAGATAATATAAACAGTAGCATAGAT
TTCAACAAATGGCCGTTGAAATAAACATTTTGAGTTCGGTTCCTCCCTTCTACACGA
AAGCTAATATAAATCAATAGCATAGCTTTCAACAAATGACCGTTGCATTTAGATGAA
AGCCCTTAAAGTTTGCCGACCCTTTGACATGTGGATAAGTAAATAATAGAACTAGGT
AATTGAAGTGGTTGAGAAATGGACATTGTGAGATTGGAATGCGTTAGCAATTGCGC
AATGCAAACTATGCTGTCGGTAGAAGGTGAAAGGATAAACCTCAGCCAATGACATT
CTATGCAGCTGTTTAGCTATAGCTTTTTGAACCTGTACAAACGATTTTTATTTTCTTTT
TAATATTTAAACCAAGAAATATAAATTTTGAGTCCAACTTCAAGGTAGATGATCGAT
TACTCATCAAATAAACTTATTTATTCCAATCATCTTTAAAATAAGAGGAAAAAGAAA
TAAGCAAAGTTCCGTTGTTGAGCAAGAAATGAAAAATTCATAGAAAGGTATAATCT
CCACCACGTAATGTGCACCTACACGCCTTCATTGACGTCGTTTCTCAATTGGATAGA
TAAAAGTTTTCTTCAAGTCTAAACCCCCTTTCATCAAGTGGTGAATTGACAC

SEQ ID No: 82
>Pear_XP_009378215.1
GCTCTTCTTGTTGCCTTCCAGCCATGGTTGAACTTTAGAACCATTAATTTA
TTTTTCTCAGGAAAACATTAATAAAAAATGTCAACAAATATTATCCAAGATTCGTCT
GTAAGTTATTTTGTCTAAATTGCAAGAGCTGAACTCATTTCTTGTAAGTTTAGTTTTG
TTCATTAGTCCTTTTATTGAAGGAGTTTCAGATAATCAATTCCATTTGCTGTACGAAA
ACTCTGTTAATTAACTTAATTACATGTATCTCTTTCGTGTTAATCTGTTTGAGATGT
ACTTAGGTTTCCAAGACATATAAATTATTTCAAGGCCCCACATAAGATATATCTTTT
AACCAAACCATGTTTTCTTGTAATCATGTATATGCATAATAATATTTTATCTTGACAA
CATGATATGACGTCTATAACGTAAAAATTAATATTGTTATAACAATAATAATGTCAT
TATGTGTTATTTAACTAAAATCTTACCGTTATTATGTAATCTTAGACTATAAATCTTG
ACGATTACGCTGTAATTAATCTTACATTTCTTGTAGTTCAGACGTTGAATGTTAACAT
TATTTTATAGGGGCTTTTAGATCCAGGTCCAAAAATGTAGAGTGTTTTTAGGAGTGA
GTCCAATTATCTAATTATATGTTTTTATTTCTTTTATACTCATTTTATATTTTCTAAAA
ATATTAAAAATCAATTAAAATCTTCTAATATTATGCATTTTCCAACTCCAAAAGAAT
ATATTTAATATCTTATAACAAAAAAAACTAATATACTAAAATAAAATTTATCTGCAAA
ACATTCTACCCTAACTCAAGTAACAAATATATGAATGTATATAATATACCTATACGT
GAGATATGAAACCTAATTAGAGGGTAAAAAAAAATAACATACCTACAAGTAAGAC
ACATTAATCTGTGACAGGTTGATTATAAAAAAGAATCTGTCATATAGGTAGATAAA
CATAATTAACCTGTGATATAGGTCGATTATAAAAATTAAAAATAAAATCTATAAATG
GGGTTTAAAGTAGGAGGAAGAACGAGAAATAACAAAAAGATAAATAAAAAGAAAT
```

| SEQUENCES |
| --- |
| AAGCAAAGAGATAATTGGGAAGAAATTTGATTTTTATAATAAATTTTATCATTGAAC |
| AAATAACTATTGATAATTAAATAATTAAATATAACAAATTGGACTTATTTTAATAAA |
| CTGGACTATTCCTACTATTGGCTCAAAAAATTGGACTTATATCAAGTTTCCCCTATTT |
| TTTTTTATAACACCAAATGTGAAGGTAAAGACCCAAAAGTGAATACTGATGAATGTG |
| AAATTTCATAACGTCTATTTTTAATAAATTGCGTCTATAGACGCTATACTATAACAA |
| GACATTCATAACCATCAAACATTAGTGTAACAATATCATTCCATAACCTCGATCACT |
| ATTTATGTAACGTTTAATAGTAAATGACAATTACAATATAATTGTTGTTATACGAAT |
| GATAGCGTAGAAATTTGCTTTATTAATTTGGGACTTAGTTGTAAAAATATCAGTTGTT |
| TTATTTCAGACAAAGTCAAATTGAAGCAATTTTGTAACGTGGTTCCTATGAGTAGAC |
| TCAACCAACTCTCTCATTTTTGTTTGTTTAGGTGGCTTCTTAAAACTAACTAATTAA |
| TACTCCCATGTCCACACTTCATATATTTATAATCAAATTCCTACGTCTCTAAACGTCA |
| AAACGGCTCGAATTTGGATAATGAGAAAAAAAAGGATTCAATCCAAAAATCCGCAA |
| AACTTGGTTTCTTGTCCCATACTATTTCTTTTCTTTTCCAACTTTCATTACCATAAAAA |
| TACTATAAACAAAACTAAACAATCTCAATTGTTTTTAAATAGTTTATTACTGGATAG |
| CCGACCAAATTCCACTGTAGCACTAAATAAATAAATAAATAATCCAACAGTTGCAC |
| AAACTTCGTATATAAAAGGCCCTACTACTTCTGCTAATCATACCCACGAAAAAAGAA |
| AACAAAAAAAAACAAAAAAACAAAAAAACAAAAAAAACAAAAGAAACACACACA |
| ATATGGATTCTCTTCTGCAATCCTTGCAAGCCTTACAATCCATGACACCACTCTTGCT |
| CATAATCCCACTCCTATTTCTCCTCCCTCTAATTTTCCGTTTCCGGCGACCACCACCA |
| TACCCACCCGGCCCCAAAGGCCTACCCCTTATTGGAAACATGTTATTGATGGACCAA |
| CTAACTCACCGGGGCCTCGCCAAGCTGGCCAAGAAATACGGCGGCATATTCCACCT |
| CCGCATGGGTTTTTACACATGGTTGCGATTTCCAACCCTGACGTGGCACGACAAGT |
| CCTTCAAGTCCAAGACAACATCTTCTCCAACCGCCCGGCCACCATCGCCATCAGCTA |
| CCTCACCTACGACCGCGCTGACATGGCCTTCGCGCACTACGGGCCCTTCTGGCGCCA |
| GATGCGTAAGCTCTGCGTCATGAAGCTCTTTAGTCGCAAACGCGCCGAGTCCTGGGA |
| GTCTGTCAGGGACGAAGTGGACTCGGCGGTTAGGACCGTCACAGTTCATGTTGGTTC |
| GGCTGTAAACATAGGAGAGTTGGTTTTTTCGCTCACGAAAAATATTATTTATCGGGC |
| GGCGTTCGGGACGAGCTCTCAGGAAGGACAGGATGAGTTTATTGGGATACTGCAGG |
| AATTTTCCAAATTGTTTGGAGCTTTTAATATTGCTGATTTTATTCCTAGCCTGGGGTG |
| GGTTGATCCTCAGGGGCTAAACAATAGACTCGCTAAGGCTCGTGAGTCCTTGGATCG |
| GTTCATTGACACCATCATAGATGATCACATGGAGAAGAAGAGGAATGGTAAGGGAG |
| TGAGTGACAGTGAAACGGACATGGTGGATGAGTTGTTGGCTTTTTACAGTGAAGAA |
| GCTAAAGTAAATGAATCTGAAGATAATTTGCAAAGCGCCATAAAACTTACTAGGGA |
| TAACATCAAGGCCATCATCATGGTAAATAACTATTACACAATTTCATATCACATATT |
| TATATTATAACCCCACAGGTTGCATGTTTATGTAACCTGTTTTCTTGGACTAAACTTT |
| TGGCTAATTTTTTCTTTTTATCTGATCAGATATATTAATTGCGTATCGAGACTATGAA |
| GATAGAAAGTATATATTATATTATTTTGAAAACTGATTGTTTAAATTGACGATCTGA |
| CTAGGTATACAACATGCTGTATATGCAAATTAATAAGCTAATTATATATGCTACGTA |
| CTTTCAGGACGTAATGTTTGGCGGGACGGAGACTGTGGCGTCGGCAATAGAGTGGG |
| CCATGTCGGAGCTGATGAAGAGCCCGGAGGACCTAAAGAGGGTCCAACAAGAACTT |
| GCTGACGTGGTGGGTCTAGACCGTCGACCTGAAGAGACCGACTTCGAGAAGTTGAC |
| ATACCTAAAATGTGCCCTAAAAGAGACACTACGACTCCACCCACCAATTCCACTACT |
| CCTCCACGAGACCTCGGAGGACGCTGTAGTAGCCGGCTACCGCATTCCCAAAAGAT |
| CGCGTGTGATGATCAACGCGTGGGCCATTGGACGTGACAAGGACTCGTGGGAGGAC |
| GCCGAGTCCTTCAAGCCCTCGAGGTTTTTGAAAGAAGGTGTGCCTGACTTTAAGGGG |
| AGTAACTTCGAGTTCATTCCGTTCGGGTCCGGTCGGAGGTCGTGCCCGGGCATGCAA |
| CTAGGGTTGTACGCGCTGGAGATGGCGGTGGCACACTTGCTTCATTGTTTTACGTGG |
| GAGTTGCCTGATGGTATGAAACCTAGTGAGCTGGACATGAACGACGTGTTTGGACTC |
| ACCGCTCCGAGAGCGAGTCGACTCATCGCCGTACCGAGTAAAAGGGTGGTTTGTCC |
| ACTCTGATGGTGATGAAAAAACAGCGTTCGACGAGGAGAGATAAACAGTGGTGCAA |
| TTTGTTTGGAGTGTAATGATACTGTGAAAACTGCACAGGTAAATTGCAAGCGTTTTT |
| TTATTGTTCTTTTGCAAACAAAATAATTACAAAGAGATCATGAACAGTTGTGGGGG |
| AATTTTGAATTCTCTCTCTTTGTGTATATACACTCTCTTTTGTTTTGTTTAACATGTAT |
| GCAAATTTATCTTTAATTTCCTCTCTTTTTTCCTTTTTGTTTTGTTTTGTTATTATTGTA |
| TTGAAATAAAAATAGAATGGCTGAGTTACAAAAATTATTTGTCATGGTGGAATAATT |
| GATGGACTGCTTATGTTACGATTTCAATTTGTTTTCTGGGTCGGTGGCAATAGTAGA |
| ATTATTTTGTTTAAAAATGATTGAAGAAAGATTAAGTAAAATTAGCTCTTGAACAAC |
| GGTAGAATAATGTTAAATCATGCTTACGACAGAAGTAGCTCACACTGTCCTCAGCAG |
| TTGTGACAATTGACACTTAATTTGACTGATGCATGTCAATTATATATTTATTTTGTGG |
| TTAAAATTGTTACATAAAAAATAAGAAGGATAAGGTTAAGGAGATTAAATTTATAG |
| ACTAAAATTGTAAACTAAATAATATGTTATCAATAAAAAATGAACACGTTTATCAAC |
| GTTTAAGTAATAATACAATCATCAACTTTCATGTCATTTAATTTACAAAATTTAGTCT |
| TCCTAGCATTACTCAAATTTGAATGATTGTGAAAATAAATTAAGGTTGGTGAGGACT |
| TTGACATAAATCTAAATATAATTAAGAAGGCTCTAAGGTAGTTCTATTCACACACTC |
| GTTTTTAGTTGTTTGAGAGTCTTATTAATTTTTGTGTATTGATCTTCTTCAATTAATTTA |
| ATCTGACGATCAGAAATCGAAAATAGTATGTGAGAAGTAAAAATTAATGTGTAAGT |
| AGCACTACCCGTGGCTTTATATATGGTGCCCATGTCAAATCGACGCATTTTGGTGGC |
| TCCATATATTTGCACGACAAGTGCCCTGGCTAGTGACCATGAACTAGTTGTGTACAG |
| TTGTGTGTTATCTCATCATGTGGAAAAGTTAATTAATTAAAAAAAGTTTATAACG |
| ACATGTGTACAACTATGTATCGACCGTGGTATAAGACCAGAAGAAGTACTGTATATC |
| ATATAACATAGGATAGTTGGCTTGATGGTGCATTCCAACCGATACATGTGTGGAGGA |
| AGTGTTGTAAATGCCTTGTTGAGCTGCATCAGCATCTGTGTGCGAGAGAGAGAGTGA |
| ATGAATATATTGAGTTTTGGTGGGCAGTGAAAAGTGAAGTGAGAAGGACGTGAGGC |
| CTTTTCCTTGTACCATGAGGATGCGTTTGTTACACCTTCTTAAGAGATTGGCTTAAAC |
| TGACTTAACTAGAACTATAATTCTACGTTTGGTATGTTTCTGGACTAGATTAAATGG |
| AACTCGCTCCAACTAACAATCCCTCCACGTTTCGTTAAAGCTCGTTATTTAGTTCGGA |
| GCTTTCGCTTGGTATTAAGCATGACTAAAATGGAAAACGAGGCCGACGCTTGGTCGT |

-continued

SEQUENCES

TTGCTACACCCGACATCCACTCTGCCTTCTTTCTGCTTGCACCGTTACTATGGCCAGG
TCGTCGGCGGTGCCTTCTCTTATGTGGCCCAACCTTAGGTGATAGCTGCAGCTCACA
GCTGAAGAGGCGCTGCTTTAGGCCAAAATCGCGAGTCGGTGGAGGACCTGGCAATG
CTACCGTCGGTGGGCGTTGCTGACGAGAAGCAGATCAAGAGCTTGACGATGAAGGT
TGGGAAGATCTGTACAATATTATGCGATTTGATTATTTGGTTGCAGGATTGGGAGAT
CTGTACATTTTTATGCGATTTGGTTGCTGACATGATTGAATGAGAAATTAATTAGC
TTTTAAAAGTTAAGATAACTATAAAATAAGTGAGAGAGTGGTGAAATTGTGGAGAT
AAAAAGGTAAGTGGAGGAGCATGCCGGAGAAATCGAGAAGGGGAAGTTGAGCAGA
GTTTGATGGGAGAAGGATTGCAGTAAGAAATTAATTTTGATAGAAAAGAAATTAAT
TTTAATAGAAAATAAAATAATTAAATAAAAATTATTGTACTTTTTTATTTGTAATCCA
ACACTACATTAAACGTTTCACTAAATCAATCTAATTAAATTTAGTCCTTGAAGCTAG
TCCAGTCCGAAATAGT

SEQ ID No: 83
>Pear_XP_009338655.1
AAACTAATGAATGATATTGTGGTGATGCTACAACACGCAATCTAATCTAA
TCTTGTAATCTTATCTTAGGTTTGAAGTACAAATTAACCCCATTTATCATATATTGCA
GTGAGGTGAAAAAGGTTTGAAATGGTGAAATGAAACCGTCAATGGCTGGAAAGTCT
AAACCCTGACAGCTACTTGGTATGTCTAATAAGGTTGAGCATCAAATCTATCACATT
TCAGATACAATACTTACTAATAAATTCATCATGCATGATTCACATTGAAGAGATCGG
GGGTTAGGTGTAGCCAAATAGGGTTTTACCCAAAAATTAAAAAGAAACCCACAAAA
TAAATCAAGATTGATTTTCCAAAGAAGCACCATCTTAATTTGACTTGTAATTTAAGG
AACCAATATGTAACTCACACACACACATATATACATATATATATATNNNNNNNNNNN
NNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNN
NNNNNNNNNNNNNNNNNNNNNNNNNNNNNTTTAAGGAAACAAATCAACAATCG
TATGAGATTGGATCAGTTTGGTGAATATATTTATATTTGGGTGGAGAGGACCAATAT
GCCTCACATGTATGTGACTAGTTCGACGAAAGTCCACAATGGCAGCAGCTCTTCTTG
TTGCCTTCCAGCCATGGTTGAACTTTAGAACCATTAATTTATTTTTCTCAGGAAAACA
TTAATAAAAAATGTCAACAAATATTATCCAAGATTCGTCTGTAAGTTAGTTTGTCTA
AATTGCAAGAGCTGAACTCATTTCTTGTAAGTTTAGTTTTGTTCATTAGTCCTTTTAT
TGAAGGAGTTTCAGATAATCAATTCCATTTGCTGTACGAAAACTCTGTTAATTAACT
TAATTCACGTATCTCTCTTTCGTGTTAATCTGTTTGAGAAGTACTTAGGTTTCCAAG
ACATATAAATTATTTCAAGGCCCCACATAAGATATATCTTTTAACCAAACCATGTTTT
CTTGTAATCATGTATATGCATAATAATATTTTATTTTGACAACATGATATGACGTCTA
TAACGTAAAAATTAATATTGTTATAACAATAATAATGTCATTATGTGTTATTTAACTA
AAATCTTACCATTATTATGTAACCTTAGACTATAAATCTTGACGATTACGGTATAATT
AACCTTACATTTCTTGTAGTTCAGACGTTGAATGTTAACATTATTTTATAACATCAAA
TGTGAAGGTAAAGACCCAAAAGTGAATACTGATGAATGTGAGATTTCTTGACGTCTA
TTTTTATTAACTTGCATCTATAGACACTATAATATAACAAGACATCCATAACCATCA
AACATTAGTGTAACAATATCATTCCATAACCTCGATCACTATTTCTGTAACGTTTAAT
AGTAAATGACAATTATAATATAATTGTTGTTAGACGAATGGTAGCGTAGAAATTTGC
TTTATTAATTTGGGACTTAGTTGTAAAAATATCAGTTGTTTTATTTCAGACAAAGTCA
AATTGAAGCAATTTTGTAACGTCGTTCCTATGAGTAGACTCAACCAACTCTCTCATTT
TCGTTTGTTTTAGGTGGCGTCTTACTACTAACTAATTAATACTCCCATGTCCACACTT
CATATATCTATAATCAAATTCCTACGTCTCTAGACGTCAAAACGGCTCGTATTTGGA
TAATGAGAAAAAAGAATTCAATCCAAAATCCGCAAAACTTGGTTTCTTGTCCCATA
CTATTTCTTTTCTTTTCCGACTTTCATTACCATAAAAATACTATAAACAAAACTAAAC
AATCTCAATTGTTTTTAAATAATTTATTTCTGGATAGCCGACCAAATTCCACTGTAGC
ACTAACCCTAAATAAATAAATAAATAATCCAACAGTTGCACAAACCTTGTATATAAA
AGGCCCTACTACTTCTGCTAATCATTCCCACGAAAAAAGACAAAAAAAAAAAACAA
ATAACAAAATAACAAAATAACAAAAGAAACACACACAATATGGATTCTCTTCTGCA
ATCCTTGCAACCCTTACAATCCATGACACCACTCTTGCTCATAATCCCACTCCTATTT
CTCCTCCCTCTAATTTTCCGTTTCCGGCGACCACCACCATACCCGCCGGGCCCCAAA
GGCCTACCCCTTATTGGAAACATGTTATTGATGGACCAACTAACTCACCGGGGCCTC
GCCAAGCTGGCCAAGAAATACGGCGGCATATTCCACCTCCGCATGGGGTTTTTACAC
ATGGTTGCGATTTCCAGCCCTGACGTGGCACGACAAGTCCTTCAAGTCCAAGACAAC
ATCTTCTCCAACCGCCCGGCCACCATCGCCATCAGCTACCTCACCTACGACCGCGCT
GACATGGCCTTCGCGCACTACGGGCCCTTCTGGCGCCAGATGCGTAAGCTCTGCGTC
ATGAAGCTCTTTAGTCGCAAACGCGCCGAGTCCTGGGAGTCTGTCAGGGACGAAGT
GGACTCGGCGGTTAGGACCGTCACAGTTCATGTTGGTTCGGCTGTAAACATCGGAGA
GTTAGTTTTTTCGCTCACGAAAATATTATTTATCGGGCGGCGTTCGGGACGAGCTC
TCAGGAAGGGCAGGATGAGTTTATTGGGATACTGCAGGAATTTTCCAAATTGTTTGG
AGCTTTTAATATTGCTGATTTTATTCCTAGCCTGGGGTGGGTTGATCCTCAGGGCTA
AACAATAGACTCGCTAAGGCTCGTGAGTCCTTGGATCGGTTTATTGACACCATCATA
GATGATCACATGGAGAAGAATAGGAATGGTAAGGGAGTGAGTGACAGTGAAACGG
ACATGGTGGATGAGTTGTTGGCTTTTTACAGTGAAGAAGCTAAAGTAAATGAATCTG
AAGATAATTTGCAAAGCGCCATCAAACTTACTAGGGATAACATCAAGGCCATCATC
ATGGTAAATAACTATTACACAATTTCATGTTACATAATTATATTATAACCCCACAGG
TTGCATGTTTATGTAACCTGTTTTCTTGGACTAAACTTTTGGCTAATTTTTTCTTTTTA
TCTGATCAGATATATTAATTGCGTATTGAGACTATGAAGATAGAAAGTTCATAGTAT
ATTATTTTTGAAAACTGATTGTTTAAATTGACGATCTGACTAGGTATACAACATGCTG
TATATGCAAATTAATAAGCTAATTATATATGCTACGTATTTTCAGGACGTAATGTTTG
GCGGGACGGAGACTGTGGCGTCGGCAATAGAGTGGGCCATGTCGGAGCTGATGAAG
AGCCCGGAGGACCTAAAGAGGGTCCAACAAGAACTTGCTGACGTGGTGGGTCTAGA
CCGTCGACCTGAAGAGACCGACTTCGAGAAGTTGACATACCTAAAATGTGCCCTAA
AAGAGACACTACGACTCCACCCACCCAATTCCACTACTCCTCCACGAGACCTCGGAG

| SEQUENCES |
|---|
| GACGCTGTAGTAGCCGGCTACCGCATTCCCAAAAGATCGCGTGTGATGATCAACGC |
| GTGGGCCATTGGACGTGACAAGGACTCGTGGGAGGACGCCGAGTCCTTCAAGCCCT |
| CGAGGTTTTTGAAAGAAGGTGTGCCTGACTTTAAGGGGAGTAACTTCGAGTTCATTC |
| CGTTCGGGTCCGGTCGGAGGTCGTGCCCGGGCATGCAACTAGGGTTGTACGCGCTGG |
| AGATGGCGGTGGCACACTTGCTTCATTGTTTTACGTGGGAGTTGCCTGATGGTATGA |
| AACCTAGTGAGCTCGACATGAACGACGTGTTTGGACTCACGGCTCCGAGAGCGAGT |
| CGACTCATCGCCGTACCAAGTAAAAGGGTGGTTTGTCCACTCTGATGGTGATGAAAA |
| AACAGCGTTCGACGAGGAGAGATAAACAGTGGTGCAATTTGTTTGGAGTGTAATGA |
| TACTGTGAAAACTGCACAGGTAGATTGCAAGCGTTTTTTTATTGTTCTTTTGAAAAAC |
| TAAATAATTACAAAGAGACCATGAACAGTTGTGCGGGAATTTTTAGTTCTCTCTCTT |
| TGTGTATATACACTCTCTTTTGTTTTGTTTAATATGTATGCAAATTTATCTTTAATTTC |
| CTCTCTTTTTTCCTTTTTGTTTTGTTTTGTTATTATTGTATTGAAATAAAAATATAATG |
| GCTAAGTTACAAAAATTATTTGTCATGGTGGAAAATTGATGGACTGCTTATGTTAC |
| GATTTCAATTTGTTTTCTGGGTCGGCGGCAATAGTAAAATTATTTTGTTTAAAAATGA |
| ATGAAGAAAGATTAAGTAAAATTAACTCTTGAACAACGGTAGAATAATGTTAAATC |
| ATGCTTACGACAGAAGTAGCTCACACTGTCCTCAGCAGTTGTGAAGATTGACACTTA |
| ATTTGACTGATGCAGGTCAATTATACATTTATTTTGTGGTTAAAATTATTACATAAAA |
| AATATGAAGAGTAAGGCTATGGAGACTAAATTTATGAGCTAAAATTGCAAACTAAA |
| TGATATGTCATCAATAAAAAAATGAGTATGTTTATCAACGTTTAAGTAATAATACAA |
| TAATCAACTTCAATGTCATTTAATTTACAAAACTTAATCTACAAATTTAGTCTCCCTA |
| TCATTACTCAGATGTGAATGATTGTGAAAATGAATTAAGGTTGGTGAGGACTTTGAC |
| ATAAATCTAAATATAATTAAGAAGGCTCTAGGGTAGTTCTATTCACACACTCATTTT |
| TACTTCTTTCACATTCTTATTAATTTTTGTCTATTGATTTTCTTGAATTAATTTAATCT |
| GGTAGCCGGAAATCAAAAATAGTATATGAGAAATAAAAATTAGTGTGTAAGTAGCA |
| CTACCCTGGCTCTATATATGGTGCCCAAGTCAGATGGATGCATTTTGGTGGCTCCAT |
| ATATTTGCAAGACAAGTGCCCTAGCTAGTGACCCGAAGAGATCTTATTTATGAACTA |
| GTTGTATACAACTGTGTGTTATCTCTCATCATGTGGAAAAGTTAATTAGTATATAGA |
| CAAAATTATCTGTAACTAGTAATTAAAAAAGTTTATAACCAAATGTGTACAACTATG |
| TATCTACCGTGGTATAAGACCAGAAGTACTGTATATCATATAACATAGGATAGTTGG |
| CTTGATGGTGCATTCCAACCGATATATGTGTGGAGGAAGTGTTGTAAATGCCTTGTT |
| GAGCTGCATCAGCATCTGTGTGTGAGAGAGAAGGTGAATGAATATATTGAGTTTAG |
| GTGGGCAGTGAAAAGTGAAGTGAGGAGGACGTGAGGCCTTTTCCTTGTACTATAAG |
| GATGCGTTTGTTACACCTTCTTAAGGGATTGGCTTAAACTGACTTAACTAGAACTAT |
| AATTCTACGTTTGGTATGTTTCTGGACTAGATTAGATGGAACTCACTCCGACTAACA |
| ATCCCTCCACGTTTCGTTAAAGCTCGTTATTTAGTTCGGAGCTTTCGCTTGGTATTAA |
| GCATGACTAAAATGGAAAACGAGGCCGACGCTTGGTCGTTTGCTACACCCGGACAT |
| CCACTCTGCCTTCTTTCTGCTGCACCGTCACAAGGCCAGGTCGTCGGCGGTGCCTGT |
| CTTATGTGGCCAACCTTAGGTGATAGCTGCAGCTCACAGCTGAAGAGGCCCTGCTT |
| TAGGCCAAAATCGCGAGTCGGTGGAGGACCTGGCAATGCTACCGTCGGTGGGCGTT |
| GCTGACGAGAAGCAGATCAAGAGCTTGACGATGAAGGTTGGGAAGATCTGTACAAT |
| ATCATTCGATTTGATTATTGGTTGCAGGATGGGGAGATCTGTACATTTTTTATACG |
| ATTTGGTTGCTGACATGATTGAATGAGAAATTAATTAGTTTTTAAAAGTTAAGATA |
| ACTATAAAATAAGTGAGAGAGATGGTGAGATTGTGGAGATAAAAAGGTAAGTGGA |
| GGAGCATGCCGGAGAAATCGAGAAGGGGAAGTTGAGCAGAGTTTGCTGGGAGAAG |
| GATTGCAGTAAGAAATTAATTTTGATAGAAAAGAAATTAATTTTAATAGAAAATAA |
| AATAATTAAATAAAAATTATTGTACTTTTTTATTTGTAATCCAAGCTACGTTAAACGT |
| TTCA |

SEQ ID No: 84
>Pear_AGR44939.1
ATGGATTCTCTTCTGCAATCCTTGCAACCCTTAAAATCCATGACACCACTC
GTGTTCATAATCCCACTCCTATTCCTCCTCCCTCTAATTTTCCGTTTCCGGCGACTAC
CACCGTACCCGCCCGGCCCCAAAGGCCTACCCCTCATTGGCAACATGTTAATGATGG
ACCAACTAACCCACCGGGGCCTCGCCAAGCTGGCCAAGCAATACGGCGGCATATTC
CACCTCCGCATGGGGTTTTTACACATGGTTGCCGTTTCCAACCCGGACGTGGCACGA
CAAGTCCTCCAAGTCCAAGACAACATCTTCTCCAACCGCCCGGCCACCATCGCCATC
AGCTACCTCACCTACGACCGCGCTGACATGGCCTTCGCGTACTACGGGCCCTTCTGG
CGCCAGATGCGTAAGCTCTGCGTCATGAAGCTCTTTAGTCGCAAACGCGCTGAGTCG
TGGGAGTCTGTTAGGGACGAAGTGGACTCGGCGGTTAGGACCGTCACAGTTCATGTT
GGTTCGGCTGTAAACATCGGAGAGTTAGTTTTTTCGCTCACGAAAAATATTATTTAT
CGGGCGGCGTTCGGTACGAGCTCGCAGGAGGGGCAGGATGAGTTTATTGCGATACT
GCAGGAATTCTCCAAGTTGTTTGGAGCTTTTAATATTGCTGATTTTATTCCCAGCCTA
GGGTGGGTTGATCCTCAGGGGCTAAACAATAGACTCGCTAAGGCTCGTGAGTCTTTG
GATCGGTTTATTGACACCATCATAGACGATCACATGGAGAAGAAGAAGAACAATAA
GGGATTGAATGATGGTGAGACGGACATGGTGGATGAGTTGTTGGCTTTTTACAGTGA
AGAAGCTAAAGTAAATGAATCTGAAGATAATTTGCAAAGCGCCATAAAACTTACTA
GGGATAACATCAAGGCCATCATCATGGACGTAATGTTTGGCGGGACGGAGACTGTG
GCGTCGGCAATAGAGTGGGCCATGTCGGAGCTGATGAAGAGCCCGGAGGACCTAAA
GAGGGTCCAACAAGAACTTGCTGACGTGGTGGGTCTAGACCGTCGACCTGAAGAGA
CCGACTTCGAGAAGTTGACATACCTAAAATGTGCCCTAAAAGAGACACTACGACTC
CGCCCACCAATTCCACTACTCCTCCACGAGACCTCGGAGGACGCTGTAGTAGCCGGC
TACCGCATTCCCAAAAGATCGCGTGTGATGATCAACGCGTGGGCCATTGGACGTGAC
AAGGACTCGTGGGAGGACGCCGAGTCCTTCAAGCCCTCGAGGTTTTTGAAAGAAGG
TGTGCCTGACTTTAAGGGGAGTAACTTCGAGTTCATTCCGTTCGGGTCCGGTCGGAG
GTCGTGCCCGGGCATGCAACTAGGGTTGTACGCGCTGGAGATGGCGGTGGCACACT

| SEQUENCES |
|---|
| TGCTTCATTGTTTTACGTGGGAGTTGCCTGATGGTATGAAACCTAGTGAGCTGGACA<br>TGAACGACGTGTTTGGACTCACCGCTCCGAGAGCGAGTCGACTCATCGCCGTACCGA<br>GTAAAAGGGTGGTTTGTCCACTCTGA<br><br>SEQ ID No: 85<br>>Pear_XP_009346304.1<br>ACAAAACCCCTTGAATTAGTTTAATTAGGAGCGCAGTTGCTATTAGCTTAT<br>TTATTTACTTGACGCATAGGCATAGGTGGGATAGGGCTTTGCTTTAGCATAGGCCAA<br>AAAGAAGCTCAATAAGCCGAAATATAGTACGTGTAAACCCCTTAGTTCCTCTTCTTT<br>ACCATAGGGTAGGGGGTGTGAAGCTATAGAAACAAAAAGGCTACTTAACAGCTACT<br>AAAGCCAATGGCGTAGCCACCCACAGGTTAAGGTGGGATGTAGCCCAGTGAGGTTT<br>TTTTGTAAGAGTAGTGTTATTTATGCACTCATTTTTACTTTTCACACATCTTTCTTAAT<br>TTTCAGTTGTTTGAATCAAATGAGATGGAGATAATCACTGACAGAAAATTAATAAGG<br>ATGTGTTGGAAGTAAAAATGGGCTTGTAAATAGAACTATTCTTTTGTAAAATCATGT<br>TTACAGTTTACTCAATTTCAATAGAGATTATTATTTAATGTATATTTTATAGAAGATA<br>GGTAATAAATAATACATTTTATGCTAAAAATTATAAATTAGTTCTATCTACAATCCTT<br>TTTTTATCATATTCTTTAAAGAAAAAGACCATTTACCCTATGTAATTTAGCCTTTGTG<br>CTTCTTACTCAAGAAAAGAAAAATAATTTCTTTAAATCCACAATTAAATCCTTGTCTC<br>CACAATATTCCTTAATTTCCGTAGCGATTTTCCAATAAATGTCACCTTTGTACTTTCT<br>TAATCTCTATATTATTCTTGATTTAATTAGTAGGTTAATTATTTATATGGTCATGAA<br>TTTATCTGTTAAGGTTATGATTTTGAGAATAATTTATATTATATTGTTGTTCTTTTATA<br>TTGATTATTATATAAGTTTATACAAGCAAAAAATAAACATATGATTTTATAGTACTTT<br>TTTTCAATTAGCCCACCCAAAGAAAAAATCTTGGCTCCGCCCTTGACTAAAGGAACG<br>CTATTTTGCTATTTTACAGCTTGAAAATGGCTCCTAAAGCTAACTACTAGCACTAGC<br>AAGAGCTAATAGCAAAACAGAGCTAGTAGCTAGCCGCTTCTATCTCTTCCTATATA<br>GCTTAGCTTCAAAATAGCCCAAAGCAATTGTCCTATAGAGCTTCCACCTTCCCTACG<br>ATATTAATCTTTAAAAAAGATTTAGTTTAGAAAAAAACCGTATGCAAGATTAATAAT<br>TAAATTAAGTAGCTGACCCATTAGTTATCATTTATTTCTTTGTTATTCTTCCAATTATA<br>CCCTTTTGTGATTGTTTGTAATGAAGACTTTTTTTTTTGGTTAACAATCATAGGACGT<br>CATTTATTATAGCTTATCTTTAGGATGTATATGATATTTTGTAGTAGTTTTTTTTTTTA<br>TTTTCATTCAAATTTCAAACTGATTTTAGTTCATATTCGAGAAATTAGTAATTCATAT<br>TCTAAAATTAAGAGGGCTATACATATAGTATATTGTAATGATATCACCTTTTTTATAT<br>ACATATTATTGTGGTAGGTACCATGATTTAAGTGCATTTGACTTGGTACTATGATTTA<br>TGTGCATTTGATTATCACTAATATTTTTTTGGACGTCTAGATGAGGTATGTTTATCAT<br>TTGAGAAAGTCAAATAATAATCAATGCCAAAAAATATGGAGCAAAATAAAACCAAA<br>TATTTAATATGGGCATTATGGGAACAAAAAAAAAACATTAAATATTTAAAAGCTAG<br>AAAATATGTATTTTAATATTTATGATGACATGGAAATTTAGTCAAAAGACTATAATG<br>AATATAAAATCTAACATAAAGTTTTAATTGAATTTCAATATTTATCAAGGATTAAAA<br>CTGAGAAACCCCTAGTTTAATTCAAGATAGCATGACCCAATGTAACAGCAACACCAT<br>AAAATTAAAAATATAAAAATCAAACGGTAGCACAAATTTTGCATATAAAAGGCACC<br>ACAATATCTCTTCCAACTTAATTAGCTACATTTTGAGTTGCCCTACAACTTCTACTAG<br>GCATACCCACAGAAAAAGTAAAAAAAAAAAAACAAGAACAAAAGAAACACACAC<br>AATATGGATTCTCTTCTGCAATCCTTGCAACCCTTCACATCCATGACACCACTCGTGT<br>TCATAATCCCACTCCTATTCCTCCTCCCTCTAATTTTCCGTTTCCGGCGACTACCACC<br>GTACCCGCCCGGCCCCAAAGGCCTACCCCTCATTGGCAACATGTTAATGATGGACCA<br>ACTAACCCACCGGGGCCTCGCCAAGCTGGCCAAGCAATACGGCGGCATATTTCACC<br>TCCGCATGGGGTTTTTACACATGGTTGCCGTTTCCAACCCTGACGTGGCACGACAAG<br>TCCTCCAAGTCCAAGACAACATCTTCTCCAACCGCCCGGCCACCATCGCCATCAGCT<br>ACCTCACCTACGACCGCGCTGACATGGCCTTCGCGCACTACGGGCCCTTCTGGCGCC<br>AGATGCGTAAGCTCTGCGTCATGAAGCTCTTTAGTCGCAAACGCGCCGAGTCGTGGG<br>AGTCTGTTAGGGACGAAGTGGACACGGCGGTTAGGACCGTCACAGTTCATGTTGGTT<br>CGGCTGTAAACATCGGAGAGTTAGTTTTTTCGCTCACGAAAAATATTATTTATCGGG<br>CGGCGTTCGGTACGAGCTCGCAGGAGGGGCAGGATGAGTTTATTGCGATACTGCAG<br>GAATTCTCCAAGTTGTTTGGAGCTTTTAATATTGCTGATTTTATTCCCAGCCTAGGGT<br>GGGTTGATCCTCAGGGGCTAAACAATAGACTCGCTAAGGCTCGTGAGTCGTTGGATC<br>GGTTTATTGACACCATCATAGACGATCACATGGAGAAGAAGAAGAACAACAATAAG<br>GGATTGAATGATGGTGAGACGGACATGGTGGATGATTTGTTGGCTTTTTACAGTGAA<br>GAAGCTAAAGTAAATGAATCTGAAGACAATTTGCAAAACGCCATCAAACTTACTAG<br>GGATAACATCAAGGCCATCATCATGGTAAATAACTATTACACATTTTTATATCAGAG<br>ATTATAACCCCACATTCAGGTTGCATATTGTCTCTGTAACCTGTATTCTTTGGACTAA<br>ACTTTTGGTTAATTTATTCTTTTTATCTGATCAGATATAATATATTGTTGTTGATTGAG<br>ATTATGAAGATAGAAAGTCTAACATATTTAACTTTAAAAATAAATAATAGTTTAGGT<br>TGATGATCTGAATACATAACATGTTGTATATGCAAATTAGTAAGCTAATTGTATATG<br>CTATGTACATGCAGGACGTAATGTTTGGCGGGACGGAGACTGTGGCGTCGGCAATA<br>GAGTGGGCCATGTCGGAGCTGATGAAGAGCCCGGAGGATCTAAAGAGGGTCCAACA<br>AGAACTTTTTAACGTGGTGGGTCTGGACCGTCGACCTGAAGAGGCCGACTTCGAGA<br>AGTTGACTTACCTAAAATGTGCCCTAAAAGAGACACTGAGACTCCACCCGCCAATTC<br>CACTACTCCTGCACGAGACGTCGGAGGACGCTGTAGTATCTGGCTACCACATTCCAA<br>AACAATCGCGCGTGATGATTAATGCGTGGGCAATTGGGCGTGACAAGGACTCGTGG<br>GAAGACCCTGAGTCCTTCAAGCCCTCTAGGTTTCTGAAAGATGGTGTGCCTGACTTT<br>AAGGGGAGTAACTTCGAGTTCATTCCGTTCGGGTCCGGTCGGAGGTCGTGCCCGGGA<br>ATGCAGCTAGGGTTGTACGCACTGGAGATGGCGGTGGCGCACATGCTTCATTGTTTC<br>ACATGGGAGTTGCCTGATGGGATGAAACCTAGTGAGCTTGACATGAACGACGTGTTT<br>GGACTCACCGCTCCGAGAGCGAGTCGACTCGTCGCCGTACCGAGTAAAAGGGTGGT<br>TTGTCCACTCTGATGGCGATGAAAAACAGAGTTGGATTGAGGAGAGAGAAACAGT<br>GTGCAACATGTTTGGGGTGCAATGTCAAAGTATACATACAGTAAAATGGCAGGTA<br>AATTGCACGCGTTTTTAATTGTTCTTTTGAAAAACAAAATAATTACAAAGAGACTTT |

SEQUENCES

```
AAAAAGTTTTGTGGGACTTTTTATTTCTCTCTGTGTGTATATAGACAGTCTCTTGTTTT
GTTTAATATGTAAGCAAATTTATCTTTAATTTCCTTTTTGTTTTGTTTTGTTATTATTG
TATTGAAATAAAATTAGTGGATGAGTTGCAAAATTATTTGTCATGGTGTAATAATTG
ATGGACTGATTATGTTACGATTTTAATTTTAATTTTTTTTTTGGTCGGTAGGAATGG
TAGATTTATGTACAGTTGTGCTTGCGATATAAGTAGCTCATACTGTCCTCAGCAGCTC
TGAAAACTGACACTGATTGACTTATTTCGATTGTACTTATTTGGTGGTTGAATTTGTT
ATATTAAAGATGTGATATTGTGCGGATGGTGAGAATGAATGAATGTTGGTGAGGAC
GTTGACATCTAAAGCTAAATATAATTAAGGCGGCTCTATATATGGTGCCCGAATCAG
ATCAATGTCTTTGGTGGCTCCATATTTGCAAGAAAAGTGCGCCTTTTGTAAATACTAT
TTATTTGGTATATAAGCGTGTCCTAGCTAGCGACCCGAAGAGATCTTGTTTACGACT
AGCTGTGTACAACTATGCGTTATCTTATACATTTATACAACTGTGCACACGTATAGA
ATTGTCCATATGTATATGTAATTAGTAAAAGAATTTCTTGTTTGTATAATTAGTTTTG
TACAACTATATGTCTATCTGATCTATGGTATATGACCAGAAGAAGTACTGCAAAGCA
TATATATAGGACAGTGCACTAGTTAACCTATGTGTGTAGGAAATGTTGCAGTGAATG
CCCTTGTTGAGCTGCATCAGCATGTGTGTACTTTGTACAACCGAGAGAGAGAGAGAG
AGAGAGAGAGAGAGATGGAATATTGAGGTTAGGTGGGAAGTGAGGACTCAAAGTG
AGAAAGACGCGAGGCCTTTTCCTTGTTTTCTTTAAGTATATAAAAATATATCGATGA
TCATGAGTCACAGTGATATATTTATTTAGAGTAATGCTAGGGAGATTAAATTTACAA
ACTAAATGATGTGTCACCAATAAGAAATGAGCACGTTTATCAACATATAAATAATA
ATCCAATCATTAACTTCCATGTTATTTAGTTTACAAATTTAGTCTCCATAACATTATT
CATTTGTTTGTGTGTGAAAGAAGATTGTGCTTATCAGTTTATGTATGTATAACTGCGA
GAGCTGGAAGGGGATCCATCGAAGATTTTCCGCCCTCAAGTAACACCTGGGGTTTTC
TAAAGTTTGGTGGCTTGGTGCTCAAGAAATAGGACGCACTGTGCTCGGTTATTTAAC
TTGAGTTGGCAAATGGACTGGGATTGAGTACCTATCCAGATGATTAAATATATATCT
TTGCATTTGCCAATATATTATCACCTTTTTGTTTGTTCTTTTTAATATGGCTAAATATC
CAAAATGGTGTCTGAGATTTGCATAATCAATAGAAATGGTCCTTGAGATTCAAAATC
AATAGAAATGGTCCATGAGATTGTCTACCATCCATGATTTTGTTCATTCCATTAAAA
ACTCTTTAGGCAATTTTCAAAACTTCGTAACTCAATCAATTCTTAACCAAATTCGACC
CATAATATATCAAAATGAAGATAGGAAAGTGTAGAACAAGATTATACCTATTTGGA
AGCCCAATGGTTGCCGGAGATAGCTGGAAAACAGCCTGAAAGGTGACTGGTTCGCG
GGAAAATTGGAAAACTCGCCGGAAACTGGGTAAACTTTAAATGTTCATAACTTCTTC
AATACTCAACGAAATCAAGTGATTCAAAAACGAAAATCATACTTCTCAATGATG
AAGATAATGGTACCTTTCTCGATGGCTAACTCCTCTACTTCGTGGACGTAGCCAAAC
TTAGGATGAACTACGTACATATTGTGTTTGCTTCCCTATCTCTATCTCTTTACATACTT
ATCCTCACTAGTGACCGGAGCAAATAAGCAAAGGTCACAAACTTGACACTTTACATT
GTTCCAAAGTCTTCACCGATTTTATGCATCAACAAGTACCAATATCATCGTTACAGTT
TATCCATCAAGATCATGACCTAGAATTGGTC

SEQ ID No: 86
>Pear_XP_009378429.1
CATGACCATAGCAGCTAAAGCCCTGTAACAGATCTAGCATCACACTGCTG
TAAAAAGAATAGTGATCTCTGAGTTTCTGTATCTCATCGATGACAAAATACCTACAA
TCGTATGTGTCAAATATTTATTTTATTATTAATATATTTGGTCCCATAATTACATTAA
TTATTAAACAATAATTAAAAATCAATTTTAATCCTATTGGTTGTCAATGAGACTCAT
GAATTAAACAATTAAATTAAGGCATTTGACTCCATCTTTGTTTGTGGTAAAAAATGT
CATATATGGACATCTCCTTTAGAGAATACCATGATATCTTTTAATCCTAGTTAACATAT
TTGACATCTCCTTTAGACATGGTAAGAATTCAAATTATTCTTCCCTTCTTTTGTCGAA
ATTCAATTAATTCCTTAATTAACTGGGGTATAATCTGTTTCCAGACAAGTGGATCCA
AAATTCCCACTGCCACATTAGTGCATTCCTCATTAAAGGCTGCAGATCCCTTATTAAT
TATATCAAGAACTCTCATAGTTTTATATGAACCTGACCAACCCCATTTTCCCAACAC
AACCAAAGCCATGGAGCTCCTTCACCAAGCTCTTCAATCCCTGCAATCTTCACCCAT
GTTGCTTATTCTTCTTCTTCTCCTCCTCATCATTTCCTTTATTTTTTGTTTAATTCGCG
CTGGAAAACTCCCATATCTGCCAGGTCCAAAAGGATGGCCATCATCGCTAACATGCT
CATGACGGACCAACTTACCCACCGTGGCCTAACCCATTTGACCAAGCAATATGGCG
GTCTCCTCCATCTCCAGATGGGGTCATACATGTTATGGCCGTATCAATTCCTGATAT
GGCACGCGAAATCCTCCAAGCCCAAGACAGCTGATTTGCCAACCGGCCAGCCAATG
TTGCCATATCTTACTTGATCTATGATCGGGCAGACATGGCCTTTGCCAACTACGGCTT
GTTCTGGCGTCGCGTGCGCAAAATTTGCGTTCGTGAATCTATTTAGCCGAAAACGGG
CTCATGGGCTTCGGTGCGCGAGGAAGTCGAGATGGTCCAAACCGTGGCAGGGAAAA
CCGGCTCCCCGGTGAATATCGGGCAGTTGGTTTTCGCTCTGACGAGGAACATAACAT
ATCGGGTGGCTTTTGGGTCAAGCTCACATGAAGGGCAAGGCGAATTTGTGAAAGAT
TTTGCAAGAATTTTCAAAGCTTTTTGGAGCTTTTAACATGCAGGATTTTTTACCATGG
TTGGGTTGGGTTCATGCACAGGGTTTTCAGGACAGAATGGCTAGGGCATGTAAGTCA
CTAGATGTTTTCATCGACAAGATCATCGACGACCATAGCAGCTATAACCCTGTAACA
GATCTAGCATCACACTGCTTTAAAAAGAATAGTGACCTCTGCGTTTCTATATATAAT
TGATGACCTAAGTACCTACAATCTTATGTGTCAAATATTTATTTTATAAATATATTGG
TCCTAACCATCCTATAGTTACTTTAATTATTAAAAAAAAAATTTAAATTGATATTAGT
TGTCAACAACACTCATGCATTATAAAATTAAATTCAAACCATATAAGTCTATCTTTA
TTTGCGGTGAAAAAGACAACTAGAAAGCAACGTCATATATGACATTTCCCTTAGA
GAGCATCTAATGTCTTTTAGCCTAGTTAGCATATTTGACAAAATGGTAAGAATTCA
AATTATTCTTCCTTCTTTTGTAAAAAGTCAATTATTTCCTTAATTAACTATAGGGTAT
AATCTGTTTCCAGACAAGTGGATCCAAAATTCCCATTGGCAATATACACAAAACAAC
GCGTGACGTTTGCAAGATAAAATACATGGCAGATATCACCACCAAAGTCGCCAGTT
ATTACTTCCCACATTAGTGCATTCCTCATTAAAGGCTGCAGATCCCTTATCAATTATA
TAAGAACTCTCATTGTTTATACGAACCTCACCAACCCCATTTACCCAACACAACCAA
CGCCATGGAACTCCTTCGCCAAGCTCTTCAATCCCTGCAATCTTCACCCATGTTGCTT
ATTCTTCTTCTTCTCCTCGTCATTTCCTTGATTTTCCTGTTTAATTCCCGCCGGAAACT
```

| SEQUENCES |
|---|
| CCCATATCCGCCAGGCCCAAAAGGGTGGCCCATCATCGGCAACATGCTTATGACGG |
| ACCAACTTACCCACCGTGGCTTGGCCCATTTGGCCAAGCAATATGGCGGTCTCCTCC |
| ATCTCCAGATGGGGGCTATACATGTTATTGCAGTATCAACTCCTGATACGGCCCGCG |
| AAATCCTCCAAGTCCAAGACAGCTCATTCGCCAACCGGCCTGCCAACATTGCCCTAT |
| CTTACTTGACCTACGATCGGGCGGACATGGCCTTTGCCAACTACGGCCCGTTCTGGC |
| GTCGCATGCGCAAAATTTGCGTCATTAATCTATTTAGCCGAAAACGGGCTGAGTCAT |
| GGGCTTCGGTGCGCGAGGAAGTCAATGAGATGGTCCAAACCGTGGCGGGAAAAACC |
| GGCTCCCCGGTGAATATCGGGCAGTTGGTTTTCGCTCTAACGAGGAACATAACATAT |
| CGGGCGGCTTTTGGGTCAAGATCACATGAAGGGCAGGGCGAATTTGTGAAGATTTT |
| GCAAGAATTTTCAAAGCTTTTTGGAGCTTTTAACATGCAGGATTTTCTGCCATGGTTG |
| GGTTGGGTTCATGCACAGGGTTTTCAGGACAGAATGGCTAGGGCACGTAAATCACT |
| AGATGTTTTCATCGACAAGATCATCGACGACCACATGGCTAAGAGGAAAGCAAACA |
| CGGAGAATAAGGATGACAGTGAGGCTGCTGATACAGATATGGTGGACGAATTGATA |
| GCTTACTTTAGTGATGATGCTGGAAAGGAAGGTGACGACCCCAATTCTGGCTTCAAG |
| CTCACCAGAGACAATATCAAAGCACTTATTATGGTATGTATATTTGACAATTAAAAT |
| TTTCTTAATACGTTATATTTGTTGGTGAATAGTCACACATCGGAGAAAAACAAAAT |
| AATATACAATTTTATGTGTGAGAGATATACTTCTAATATCATCGAGATTTTTTAATGA |
| TAAAATTCAATACATAGCAATAAGTGGTTAAGTTAGAACAATAGATACACTTTATTA |
| ATTTTTAAGAAACAAATCTGATTTTAAGTATTTGTTGTTAACTATTTTTGTAAGGAAT |
| TAGGAGAGAAAACTATTCTGATAAGGAATTCATGTACTTAATTATTACTATATTTAT |
| CATTTCCGATTGATTTAGTACTAAATAATACGATTATCCCATATATACGTAGGATGT |
| GATGTTTGGTGGAACAGAAACGGTTGCATCAGTGATCGAATGGACAATGGCAGAGC |
| TGATGAAGAGCCCAGAAGATCTCAAAAGAGTACAACAAGAGCTCACTGATGTTGTT |
| GGATTGAACCGTAGGCTCCAGGAAACCGACCTCGAAAACCTAACCTACCTCAAATG |
| CGCAGTCAAAGAATCCCTTCGTCTTCACCCGCCAATCCCTCTCCTCCTACACGAGAC |
| CGTGGAAGACACCTCTGTGGCTGGCTACTCGTTCCCAGCCGGGTCACGGGTTTGGAT |
| CAATGCATGGGCTATTGCTCGTGACCCGACTGCATGGGACGAGCCAGAAACATTCA |
| AACCCTCGAGGTTTCTGGACGATGGCTCGCCTGATTTCAAAGGGAGTAACTTCGAGT |
| TTATTCCTTTTGGGTCTGGTCGGAGGTCGTGCCCGGGAATGGCGTTGGGGCTGTATG |
| GGTTGGAGATGGCTGTGGCTCATCTGCTTCATTGTTTTGCATGGGAGTTGCCCGGTG |
| GGATGAAGCCTAGTGAGCTTGACATGAATGATGTGTTTGGACTGACTGCACCAAAA |
| GCGGTTCAACTTGTTGCTGTGCCAACTTATAGGTTGAATTGCCCCCTTTGAATTAATA |
| GTTTCAAGTAGACGAGGAGACGATGATGATGAAATATTACTTGGTTTTAAATCAGTG |
| ATCGATGAGTAAATTTCTCTATGTAAAGGTACTTTAACGAATAAGGGTTTGTTACGT |
| TCTTGGTCTCTCTTTACCAATTGAATAATACTATTGCTTTCCCCATGAGGGACGAGCT |
| CATTATTCCTCTATTGCAAATAACAATATCTTCAACGTAGAAATTTCATAATTGGATC |
| AGTTCAATATCTTCATCTTCATTTGAAGATCATCCTTACAAAAAATAATTTGAATTTT |
| TTATTGTTTCATCATCCAAATGTATAAATAAATCAACGGTTTATCATGAATATGTTAC |
| TTGATACCTACACTTATGATTTATTTGATACATTTGGATGGCTAAACGATCACCTCAA |
| ATGATTTTTTGGAGGAATGATCTTAAAATGAAGATTAAGACGTTGCTTGCAACTGGAGG |
| TATTAAAAAAAAAAAAAAAAAATCTATGTTAAAGATACGTTGCTTGCAACTGGAGG |
| AATGACCTCGTCTCCCAATCCCAAGGAGAGTATGTAAGCATTATCCATTATTGTAAT |
| AATCATTTTTAATTTTGTAATATCGCTATGTCGTTAATATTTAATATAAATATATGCG |
| TGGTTGTTTGTTAACCTTTGTTGGCTTTCTGTCCTTTGTGGCTCAGCCTTGTATCTTTT |
| AGTCAGTTTTTCGAAGACAAAACGGGAAAAGATTCCATCCAGATCTCTCCCACCAAA |
| TCCTAAGGATCCGAAGATCCGGATCCTTAAAATTTGATTCAACGGCCACAAACAAG |
| AGGTTCTTCTAAAAATTATAATAATTATAGTAGTTAGATCAAATTTCAAAGGTCCGG |
| ATCTCTAGGACTTGGTGGGAGAGATCCGAAGGGGATCTCTTCCCTGACAAACAAGT |
| GGGGATGTACTTTTAATGTTGGACTGTTGAAGTCCTGGAAAAACATCTTTCGTCAAA |
| CTATATAGCAAAATAGTAGTAAGCTAAGACGCTTATGGTGTTAGATAATGGATTGAG |
| GCTATTGATCAAGATGAATCTTTCGTAAATTTATACCAAATTTATGATCTCACAACAT |
| AATTTGATGAACTTGATATGCAATATTGATCACACAAAGACTTCATCTTATAGAATA |
| TTGGTTTATATCCTAAAAAATTAAATTTGTAGGGTTCATAAACTGTTCCATTAGGTGG |
| TAACATATTAATTTGATATTGTGATGATACAAAGCTCAAATTAACAGTATTGTTATC |
| AACTAACTATTGGTCTGGTAATTTTTTTTTCTTCCCTAATGTTGGAATAAATATCTT |
| GATTTCGATTCCACTCTTCTATACAAAAGATAATATAAATAGGAGCATAGCTTTCAA |
| CAAATGACCGTTGAAATAAAAATTTTGAGTTCGGTTCCTTCCTTCCACACGAAAGAT |
| AATATAAATCAATAGCATAGCTTTCAACAAATGACGGTTGCATTTAGACGAAAACCC |
| TTAAAAGTTTGCCGACCCTTTGACACGTAGATAAGCAAATAATATAACTAGCTAATT |
| GAAGTGGTTGAGAAATGGACATTGTGAGATTAGAATGCGTTAGCAATTGCGCAATG |
| CAAACTATGATGTCGGTAGAAGGTGAAAGGATAAACCTCAGCCAATGACATTCTAT |
| GCAGCTGTTTAGCTATAGCTTTTTGAGTCCAACTTCAAGGTAGAAGAACGATTACTC |
| ATCAAATAAACTTATCATTCCAATCATCTTTAAAATAAGAGGAAAAAGAAATAAGT |
| AAAGTTGCGTCGTTGAGTGAGAAATGAAAAATTCATAGAAAGTTACAACCCCTACC |
| ACGTAATAGTGCACCTACATGCCTTCATCGACGTTGTTTCTCAATTGGATAGATAAA |
| CGTTTTCTTCTAAGTCTAAACCCCCTTTCATCGATGTTGTTTCTCAATTGGATAGATA |
| AAAGTTTTCTTCAAGTCTAAACCCCCTTTCATCAAGTGGTGAATTGACACAATGACT |
| AGGACAT |

SEQ ID No: 87
>Peach_XP_007199246.1
ACCGAGATCTTTTGTGATAAAACTTCATACTTATTAAGCTTTGTAGATAAT
TAAATTGTAAATAATATCGATGTTGTTAGTTGTGTACTACTAGTCTTTCTGAATTTAA
CATCTACATCATAAGCAGTCCACATCACATATTATACATCTGACCTTTTATACAGAT
AATCTTTTGTATACCAAACAATATAGTAAGTCCCCAGTAATGACTTGCCACGTTAGC
CCAATCTTCATAAAGGCTGCAGATCACATTTTAATTATATAAGAACCTCATCCTTTTC
TTTTCAACCTTATCAAATTCATAATTTATATTAACCTCCTCACCAACCCCATTTTCAA -continued

SEQUENCES

```
GAACACAAACCAAGCCACGGATGATCTCCTCCTTCACCAAGCACTTGAATCCCTGCA
ATCTTCTTCCATGTTGCTCGTTCTTCTTCTACTCATCTTTTTCTTTATTGTTTTGTTCAT
GTCACGCCCAAAACTCCCATACCCATCAGATTTGAAAAGGGTCCAATTTCATTCAAT
TACTGCTAACACACCTCCAACCCCCAACTTTCTTCACATATGATGGCAATTTGAAAA
TTAGAAGTTAACAAATTAGTGAGAAAAAGGAGACAAAATCGCTAGTCTTGGCGTAG
CCACCGAAAGGGTGAGAAGAAGATTGAGCAATGATTAAGCTGTTGAAGAGAGA
GAGAGAGAGAGAGAGAGAGAGAGAGGGAGAGAGAGGCCGAGAAGGCAGCG
CGAGGTTGACGATGGGTTGGGGTGGGTGGTGGCTATTTTCTTTTTTCATTGAGTAAT
GCTACTCTTACTACATTCTTGTACCACCTTACTTAGCAGATAAAGTGTACAGCTACAT
CAATTAGAAACTGTTAATAAATCATAAAAGAAAAAAAAATATTCAATTAATTTTAAT
TGATGTGGATTGTCCACCTTATCTGTCACTTAAAGTGGTATACAAATATGGTAAGAG
TAGTATTATTATTTTTTTTTCTTTTTTGATTTTCTTAGTTTTATTTAAAAGGATAATA
ATAATTAGATTCCAAGTCCACCTATAAAAAATATAAATTTTTATTCTTAAATGACA
CATGGCAAATTTTCAATTGGAGTATCACAAGTTGAGATGGTAGTGGAGTACCACTAG
GGGTGTACGTCGATTTGAAACTAATACAATTTAATCCATATTCGATCCAATATAAAT
TCGATTGTGATATTTTCAATCCTATCCAATCATATTAGATGTTTAAATTCAATCGGAT
ATGATCCAATTGATATTGGACTGGATTGGGTTGGATGATTGGTTTTGAACTTTTGATA
ATGAAAAAAATATAATATTGAAATATTAAACATTTATTCTTAGGTTTAATCTAATCA
AACATATTAAGACGTAAATGTAAAATATAAATGAAATATCAGAGAAAATTGTTTTG
ATTATATAATATATTAAATATAATTCCATTAAATAACTTAAAATATTCATAACATTTT
CAACTACAACTACCTATAAGAGCAAAATAAGCATTACTATAATATTAGACCAAATTT
TAGCTAGCTAATTAGTATGTTTGAATTAATTTCCTTATAAAAATTATACGATATGTAA
ATAATATCGACACGAATCCCGAGTTTCTAGATTTAAAGACATTCCACTTCTACATAA
GCAGCCCAGATCACATATTATACATGTGACCTTTTATATAGATCCTTATTAATCTTTT
GTATACAAAACAAAACGAATTAAAAGAAATCCCAATACAATTTCAAATATTTCCTTA
GTGCAGACAAGTGGAGCCAAATTCCCACAGGGAATGGAGTTGGTGAGATTAGATCA
TCCTCTATTGTAAGTCCCCAGTAATTACTTGCCACATTAGTTCAATCCTCATAAAGGC
TGCAGATCCCATTTTATATATATAAGCAACTCATCCTTTTCTTTTCACCTTATCAAAT
TCATAATATATATATATCAACCTCCTCAACAACCCCATTTTCAAGAACACAAACCAA
GCCATGGATGATCTCCTCCTTCACCAAGCACTTGAATCCCTGCAATCTTCTCCCATGT
TGTTCATTCTTCTTTTTCTACTCATCATTTCCTGGTTTGTTTGTTCATGTCACGCAGA
AAACTCCCATACCCACCAGGGCCAAGAGGGTGGCCCATTATTGGGAACATGCTCAT
GATGGACCAACTCACCCACCGCGGTTTAGCTCAACTGGCTAAACAATATGGTGGGCT
TCTCCATCTTCAGATGGGGGTCTTACATATCATGGTCGTATCATCCCCGAAAGTGGC
CCGAGAAATCCTCCAAGTCCAGGACAGTTCCTTCGCCAATCGGCCTGCAAATGCTGC
CATATCATACTTGACGTATGATCGGGCCGATATGGCTTTCGCCAACTACGGCCCGTT
TTGGCGTCGCATGCGTAAAATTTGCGTCATAAATCTGTTTAGTCGGAAACGGGCCGA
GTCATGGGCCTCAGTACGTGAGGAAGTTGAAGAGATGGTTCGACATGTGGCAACAA
AAACCAGCTCACCGGTGAATATCGGTCAATTGGTTTTCACTCTAACGAAGAACATAA
CTTATCGGGCAGCGTTCGGGTCAAGCTCCCATGAAGGGCAAGGAGGAGTTTGTGAAG
ATTTTGCAGGAATTCTCAAAGCTTTTTGGGGCTTTTAACATGCAAGATTTTCTTCCAT
GGTTGGGTTGGGTTCATGCACAGGCTTTTAAGGACAGAATGGCTAAGGCTCGTAGGT
CACTAGACGTGTTTATTGATAAGATCATCGATGATCACATGGCTAAGAGGAATACAA
ATAAGGCCAAGAAAGATGACAATGAAGCTGAAACAGATATGGTGGATGAATTAATA
GCTTTTTTTCAGTGATGATGCTGCAAAGGAAAGTGACGACCCCAATTCTACCTTTAGG
CTCACCAGAGACAATATCAAAGCTATTATCATGGTAAGTCTTACATGAAAATATAAT
GAGGATTCATAATATCTCCATATTATTATCGTCAGCAAAATATACCGACATGTTGTT
GTTGCATTTTTATAATATTTATGTGCGTGTCCATTCTTTAAATAATATATCCTGCATA
GAGAATTTTTGATATATATAACAGTCCATACATAGATATTTATTAATAATTATTTTTT
CAATTTTAAGAAAACCTCAACGGAATGAGGGAAATAATTATTCTTTTAATAAACATT
TTAATACATTACTATAATTTTCTTTCCAATATTATTAACTACCAAACCCCCGTTCTAC
TGATCACATCGTTCTCCAATATTGTTGCCCTTTATTTGAGGTGCCAACTCGGTCTAGG
GGTTTTCCTTTTATTTATTTTAATTATCTAAAATTGAAATTTTTTTATTTATTTAGG
TAACTTCACAAGCGGATTACATTGTAATTAATATTTTGTAATAGGTGGGTCAATGCT
TTTTTCCTTTTCTAAATCAAAAGAAACAAATCTGATTTCTTGTGTTTTTACTATATTT
ACTCAGAATTTATGGTAAAATAAAGCACATTCTCATTTCTCACTCAGAAGATCAATA
TTATGTGTTCAATTTTGGTAATGGAAATTATGTGTTTAATTACTCTGTCACTTCT
GATTTACCACTTTGCATTCATAGGATGTAATGTTTGGAGGAACTGAAACGGTGGCGT
CAGTGATTGAATGGACAATGGCAGAGCTGATGAAGAGCCCAGAAGATCTCCAAAAA
GTGCAGCAAGAGCTCATCAATGTTGTTGGCTTGAACCGTAGGGTCCAAGAAACTGA
CCTCGAAAACCTAACCTACCTCAAATGTGCAGTCAAGGAATCCCTCCGTCTTCACCC
ACCAATCCCTCTTCTCCTCCACGAGACTGCAGAGGAGACTTCCGTGGCCGGTTACTC
ATTTCCAGTTGGGTCACGGGTTTATATTAATGCATGGGCTATCGCCCGTGACCCGAC
TGCATGGGATGAGCCAGAAACATTCAAACCCTCGAGGTTTTTGAAAGATGGCTCGCC
CGATTTTAAAGGGAGCGACTTCGAGTTCCTCCCATTCGGGTCGGGCCGTAGGTCGTG
CCCGGGTATGCAATTGGGGCTGTATGGGCTGGAGATGGCTGTGGCCCATCTTCTTCA
TTGTTTTGCATGGGAGTTGCCTGAAGGAATGAAGCCTAATGAGCTTGACATGAATGA
TGTTTTTGGCCTGACTGCACCCAAAGCAGTTCAGCTTGTTGCTGTGCCGAGTTACAG
GTTAAATTGCCCGCTTTGAATAGTTTGAGGAGATTGTGAAATACCTTTGGTTTTAAA
ACAGTGATGAGCCTATTCTTTACGTATTGGTACTGGCCGCCGGTCCTGAATTTTTCA
GGCCCCAGGGCAAAAGTAAAAATTATGCCCTTATATATATTTTAAATTTAGTGATGA
ACTCACTTTCATTTTTCAACCAAGATTTAACCTGTTCACATTAACTAAACATTTAGCA
AATAAATTATTTCAATTCAAACTTCAAAATAAAAGGCTACAATGTATAAACAAGATA
AATACTTGTAACAATTCAGTAAGTTCTTTTTCATCCGGCAACAAGCAACCAACAAAT
CAAAAATTTATATGCATGCTCAATAGCCAAAGCAAAACAACATCAATCTAGTTGAA
ATCCCTTTGCATCCTCGTCCACCAGCAAAATAAAAAATGTCTTTGCATCCTCAACAA
CACAAAGAACAACATAACCTGGAATTTGAGAAATCCCCCTCCACAACAACAAACTT
```

-continued

| SEQUENCES |
|---|

GATATTTCCAAATTTGCAATCAGTTAGATCTTAAAAGAATTCTTGCAAAGAGAATGT
GTAACTCATGTGAGTTCACAAATCTACAAAAAAAATAAAAATGAAAAAATAATATT
TTCCTTTTCATTTGATATCAAATCATGAAAAATTACTTTCAATTGATTTTTACAAGGA
CTGATTTTGTACTGAACAAAAGTCCACACTTTGAATTTTGTAATCTCCCTAATCTACC
AATAGAAAAATTAATTTAGGGATTCACAACTCTGTAACTAGTAGGAGAGGCTTAAA
TGAGATGAGAAGAAGAAGAGGAAGAACGAGAAAAAGAAGAAGAAGAAAAATTTTA
AATAGATAAATCTAACGTTAACCTGGAGGAGTGGAGCGGGTTGCGCAAAAGGGTTC
TTCTTGAGAAGCGAAAAGGATGCACGTTCTTCCAAAACACCATCTTTTTTTTTTTTT
TTTTCTCAAAAATATTAAATCAGTTTATAATAATATAATATAACACTTTTTTTTAAAA
AAAAATTGAGCCCTTGAATAATAGGCTTAGGGCGGTCGCACTAACGGCCCTTGTTCA
GGCCGGGCCTGTTTTAGTCTTCTATTTGTTCAGGCCCTATCACTGACTCGTTAGTACA
GTTTGTTTGTATGGATCGATCAAATAAACAAACCAAAATATTCCCAATAAGAATCAA
ATGATTAAACAATGTTGGCTAATTTTTATAAGGGGTGATCTTTGAATGATAATCTGA
AAAACGAATGTCCAAATTATGAGATTATATTGCTAAGTGGACCAAAAAAGTGATCA
ATGCCGTATTAACTTACTAATCGATTAATGCTTGATCACTCCTGATCAAACAACTAA
GCCACATAATTATTTATGTAAAAATTTGGCCGCAAGTAACAAAAATTACTTGTAGAC
GAAAACCCATATGTTAGCAATTATTTTCAAACGAAAATATACAAACCGCTCCCTTCG
TGTGATGATTAATTTGTTCATACAAGGAGGAGGGAGGGAGGAACATTTCAATTTAAT
CATACAACTGGGATCATGCCATTTCAGGCATTGGGCTTCTTTTATGCTATAAATTACT
CATACAATCAAAATTGTTACTTAGGCCTTCTACGGTAAGGGTATAGAATGTCATCCA
CACTCTGTTTGATATAGCTTCCCACTCTATTCACATTCTTAGCAACACCTGATGCTAC
TAGTATTGCATTCCTCTTAAACCTGCATATATACAAATACTCAGAGTTTTAAAGTCTA
ACAAGAACAAACTGAACTGGAAAACTCAAACACAAAACCATGTGAAAAAAAGAAA
GTCATGGATAACTTCTTTTCTTTGCTAACTCAAAGTTCTACCATACCTGTTGAGATAT
TCATCTCCTGTTGAATGTGGTGGTCTGTAGCTTTGGGGTTGAGGAATCGGCCGAACA
TTTTCTGGAGACACACCAAGAATTTATAAACAAGGTTGCTGTGAATGTTATAAGAAA
ATTCAGTCATTTTGCAACACTAA

SEQ ID No: 88
>Peach_XP_007203643.1
AGCACATCTAAACTTATCATTTTTGGGGGATTTAAGTCATAATGATTTAGA
CACCTCAAAATGGGCCATGATTTATCAACTAATGAGGCATGGCTTTGGGTGCTCTGA
GGTTTTCCACAGCGCGATTCACACTGCTAATGGATGAATGAAATGAATATTATTTGA
TGAAAATGAACGAGTGGGAAAATATCAAATCAAATCCCACAGGGCACAGGGCACA
GGCCACAGGCATTGAATTAATTATTAAATAATGATGATGTTATCATGATGCTAAAA
CACGCAATCTAGCTACTTATCTCCTAATTCTGTAATCTTATCTTAGTTTTGAAGTATA
TTAACTAAACACAACACCATTTAACACATTGCATTTCCATAAAATATTTGGAAGAGA
AAAAAGAGGTTGAAATGGTGAGATGAAACAGTCAATTGCTCGAATGTCTAAACCTC
GACAGCTACCTGAAATGTATAAGGTCCTGCATCAAATCTTTCACCTTTCACATGGAC
AGACTGACCAATTGTTATGTGAAGCCTCAAACATACACTTTGCTATACACTAATGAA
TCATCATTCACGTTGAATAAAGAATTAGGTGGCCAGCTAGCTGTGCTAGCTTTAACC
CTAAAGACAAATAGAAACTCCCAAAACAAGCTCGGTTTGTTTTCTAAGCACCATCAA
TTTGAATTAAAATTCAAGGAACAAAAATTCAATAAATTATTTAGTGAAATATGTACC
TATCCGGGTCACTATTTTTTGGCTTAAAAATGTTAAATGATAAGATACGGTTAAGAT
GGATGGTTTTTTAAGTACCGTTTATAACAAAATTTCTGCCAACAAAATCTAGCACAT
TAGAAAGGGACTTAGTACTACTAAAAAAAAGAAGATGAATGAGGCATGCCATCATG
AAGTGTTTTTCCTGATTAATTTTGTGAATTAAACAAAGTATACTGGACCCGAATGTT
AAATGTGACTAGTTCGAGGAAAGTCCACAATTGCAGCATATGTTTTTTTTGTCTTGC
AGCCATGGTGGAACTTTTCGGAACATTCATTTAACATTTGTTGAAATTCGTGCACAC
CATTTATTATTGAGCTTGCTTGTTCTTTTATTAGTGATACATATTTGCGAAAGTTGAG
TTCATTTCTTGCAAGTTACAATATAGTTACTCAATTGCGGGAAATTGAGATAACCAA
TTTAAATTCTGCTAACTAACTTCTTGCAATTAACTTAATTATACATCTCTCACTCTCT
AAAAGTCTTGACTTCAAGTCCTATCATTTGTATAATGCGTGTAATTTTAATATATTAT
CGCCACTTTCAATAAAAAATATTCTTAAAACAATGTTATTTCACCTTCTTATTCTTTA
AATAAAAAAGAAAAATGATACTTTTCAATCATATACGGAAGCTTCATAATATTTTTT
TTTCTCTGTTAATTTCATTAATTCTAGAAGTATTCAATTGCTTTACTTCAGACAAAGT
CAAATTAAAGCAATTTTCACAAAAATAAAGTAAAAGCTACCTACTCTCTTTTTTTTT
GTTAATTTTATATTTTATTTTATATCGAATCGAAGTCGACTGCAAAGAGGCGAAGAA
TGCCTTTATACCGCTTTGACTAATTGATCTAAACTCATGTACATATTGCAGATAAATA
TCCCTCATCACCGTTTATAAAGAAGGAATGTTAGTACGTATCTATACGTCAAAGCAG
TTTGGAAATCCATATCTCCCAGTCTTTTCCCAGAGTCTTCTAGTTTTACGCTTACTCA
TTCAGAGACAATAGTCCAACTTCCATCCATACCACAAAACATAAAATAATATTAAAA
CAAAATAAAAGACAATTTATTCAATTCATTTAAATTCTAAATCGCGTGACTAAATT
CAACAGCAGCACACAAACTTTGTATATAAAAGGCCCCATAATATCTCATCCAACTTA
GCAACATTTTGAGTTGCACACAACACCCAAACTACTCTACGCACCCAAAAAAAACAC
AAACCACATGGATTCTCTTCTCCAAGCCTTGCAACCCCTACAACCCATGACACTCTT
CTTCATCATCCCATTCCTCTTCCTCTCCGGCCTAGTCTTCCTATACCGGTCCCGAAGA
CGCTCCCCCTACCCACCGGGCCCCACAGGCCTCCCCATCATCGGCAACATGCTGATG
ATGGACCAACTAACCCACCGAGGCCTTGCCAAACTGGCCAAGCAATATGGCGGCAT
CTTCCACCTCCGCATGGGGTTCCTCCACATGGTCGGCATTTCAAACCCTGACGTGGC
TCGCCAGGTCCTCCAAGTCCAGGACAACATCTTCTCAACCGCCCGCCACCATCGC
CATCAGCTACCTCACCTACGACCGGGCCGACATGGCTTTCGCCCACTACGGTCCCTT
TTGGCGCCAGATGCGTAAGCTCTGCGTGATGAAGCTCTTCAGCCGGAAGCGCGCAG
AGTCCTGGGACGCCGTGAGGGACGAGGTGGACACGGCTGTCCGTACCGTCGCTGTT
CAGGCCGGTTCGGCTGTGAATATAGGGGAGCTGGTTTTTTCGTTGACGAAGAATATT
ATTTATCGGGCGGCCTTCGGGACGAGCTCGGAGGAAGGGCAGGATGAGTTTATTGG
GATATTGCAGGAATTTTCGAAGTTGTTCGGGGCTTTTAATATTGCGGATTTTATTCCT

| SEQUENCES |
|---|
| TGCCTTGGTTGGGTTGACCCTCAGGGGCTCAACAACAGGCTGGCTAGGGCTCGTCAG |
| TCGTTGGATAGATTTATCGACAGCATCATAGACGACCACATACAGAAGAAGAAGAA |
| GAAGAAGAGTGAGGGATCGAATGGCGGTGAAACTGATATGGTCGATGAATTGTTGG |
| CTTTTTACAGTGATGAAGCCAAAGTAAATGAGTCTGACGACAATTTGCAAAACGCCA |
| TCAACCTTACTAGAGATAACATCAAGGCCATCATCATGGTAAATTATTGCGCTTTCT |
| ATACCATATAAAACCACAATTAATTCGGAAAAATCTGAAAATGCTTACGTATTATGT |
| TGTTAGACTGTAAGTTTCTATCGGATAATATTATTTTGAATTGATTACGAATCAAATT |
| CACATTCCAACAACGTAACATATCAGTCATTTAGTAAACTAAATAAATGAACTAATT |
| AATTGACATGTGTTGCATGCAGGATGTTATGTTTGGCGGGACAGAGACGGTGGCATC |
| GGCGATAGAGTGGGCCATGGCAGAGCTAATGAGGAACCCAGAGGAGCTAAAGAGG |
| GTCCAACAAGAACTTGCTGACGTGGTGGGTCTTGATCGCCGACCAGAAGAGGGAGA |
| CTTTGAGAAGTTGACTTACCTAAAATGTGCACTTAAAGAGACACTGCGGCTCCACCC |
| TCCGATTCCACTGCTCCTCCACGAGACGGCGGAGGACGCGGAGGTGGCCGGCTACC |
| ACATCCCTAAAAAGTCACGCGTTATGATCAACTCGTGGGCCATCGGGCGTGACAAG |
| GACTCGTGGGAGGACGCCGAGTCCTTCAAGCCCTCTAGGTTTTTGAAAGAAGGTGTG |
| CCGGACTTTAAGGGGAGCAACTTCGAGTTCCTTCCGTTCGGGTCCGGTCGGAGGTCG |
| TGCCCGGGCATGCAGCTCGGGTTGTACTCGCTGGAGTTGGCGGTGGGGCATTTGCTC |
| CACTGTTTTACGTGGGAGTTGCCTGATGGAATGAAACCCAGTGAGCTCGACATGAAC |
| GACGTGTTTGGACTCACCGCTCCCAGAGCGAGTCGACTCATTGCCGTACCGAGTAAA |
| AGGGTGGTTTGTCCACTCTGAATCTGATGATCTCATGACGAGGATGAGAAAAACAG |
| AGTTTGCATGTGTTAATTGGTGTCCCAAAATTTCAAGTATACATAACAATGAAACGG |
| CGACGCACAGGTAAATTGCAGGGTTTTTTTTTTTTTTCTTCCTTTTTTTTATATTTA |
| AAATATTTGGGAAGAACCCAGAAAACAAATAATTGAAAAGAGACTTTGGAAAAACG |
| AAATGAGGGAATTTGTATTCTCTTTCTTTGTGTATAAACACTCTCTTTGATTTGTTTC |
| ATATGTATGGAAATTTGTCTTGGATTTTCTCTCTTTTTCCTCTTTTTTTTTCCCTTACT |
| ATTGTATTCAAATAATGGATCAATTTGAAAAATATATATATTTGTCACAGTGGAAAA |
| AAAATAATATTATTATTGCAAACACTTGGTATATAATTTTGTGTAATTTGCAATTCTT |
| TCTCGTGACTTTAGGGAAGATATGTGGCTGGATGTGTGAATATTTATATTAAGTTTGT |
| ATATGCTTGCGACTGAAGGTGTTCATACTGTCATCAGCAACTCCAAGAATTGACACT |
| TTTGACTATTTCACTTGCTATATAGTGCTAAATGTGAATCTCAATATAAGGCTCTATG |
| GTGCATGAATGAGTTAGAGCAAAGTATTTTGGTGGGTCCATTGACGAAGTTTCTCAA |
| TAAATCAATCATGTGATGAAAGAGATAGACACAATTATACAATACGGAGTATCAGG |
| GTAGCCGCCCTGCCCGTGGTGCAATATGCATCAAACATGTGCATGCAAAAGAGTGTT |
| GTAATGCGCTTGGTGTAATATACTAGGTACTCACGAAAATTATACTAGTACTGAGCA |
| CTGGAGTGGTGCAATATGCATCAAACATTTGCGTGCAAAAAAGTGTTGTAATGGGCC |
| TGGTGGCAACAAAACATGTTTGTACTTGGTACAATTGATACAGAGAAGGAGAGAGG |
| GATATATAAAATATATTGAGTTTAGGTAGGCAGTGAGGACAAGTGAGGAGGACGTG |
| AGGCCTTTCTTGTGTTTTCTTTGGGTAGAATAATGAGACTGGGCATGAGGTTGAGAG |
| GTGAGGTGAGGTGGAGGGAGGTTCCATCTGAGATTTCCCATCTTCAACAAACGTGG |
| GATATGGACAATAGAGGACATAAGGGCCACCAATATGTAATCCAATCAGATTCAGT |
| AGGATATTTGTATATTATATATCCATCCTTGTCCCTTTTTGTAAAGTTGGTGGCCTGG |
| TGCTTGAATAAGACCCCACTGTGCTTAGAAGTTTAGCTTGCGTTTGGGAAATGGAGT |
| GGGGTTGAATACTATCCTATCCAATCCAGTTCAAACACACCAACCTATTTCCATCCC |
| ACTCCATTTTATTTTTAAGGCCTCTGTATTGCATTTGTGTATATGCCGCACTCAAATT |
| AGACTGATGAGTTTTGAGATCAAACTTTGGAACACCCCAGGATGTAGATGTGTACAG |
| AGAAGACCTAGAGATAGATTGATGAATGCGTTTTTATTTGTTAGATTGGAGGAAACC |
| GAACTCTTAACTACTCGTCATAACCTATTACTCCAATTTCATTCCTTACCCCATTTGA |
| GTTAACTCCCAAAGATTTTCAGTCACAAAATAAGGGTTACAACTTGAACTGTTCATC |
| TAGTGTTGAATAATTAGGAGTTATAATGAGAGGATGCTTAATAGTCACTGATTAATT |
| GCACAGCTATTAGTGGAAGGTTTTTTTGGTTTTTGTTTTAAAAAGAAACAAAATTAT |
| TAATAGATGCTATCAGACCCAGCCAAACCCAGCCCAACAAACTTATTGACGTTGGA |
| CTTGCATCATATTGGCACATGAGAGAGAGAGAGAGAGAGAGAGAGAGAGAGAGAG |
| AGAGAGAGAGAGAGAGAGAGAGAGAGAGAGGACTTAATTGAATTCTAACAAGA |
| TGAATATTTGGATTGCGTAATTGAATTCTTCCTCGGGCTAGGCCCCACTTACAATGTC |
| CTAATCTTTCACATCTTTATCATATTTCTTAAA |

SEQ ID No: 89
>Banana_XP_009384541.1
TTAATTAGACTAATTATATATTATTTTCATAATTAATTATTTTAGTATCTCA
ATCGTTATATCTTCAAAAATTATATTGAAATCCTTATACTTATTTTTTCTCACCTGCCT
GTGATCTCATTATGTGAGAAGACGCCAAGCCAAAATTGATTGATTGATACATTGTTC
GTGGTGGGAGCTGTAAGCACATCATTCGGTCACTCCCTTTGTTCGAAGTCCCTTCAG
CTGAAGCATCAGAATCCACAGTGTATTTGCTCACCGGCAAATGAAAGTACTCTGTGA
AGGTAGGTTAAGGTTATGGAAGACAATGACCTCTCTCTCTCTCTCTCTCTCTCTTC
ACCACCATCACCCATTTCTAAGTGAGCATAAATCCCAGAGACTTGAATGACAAGCTC
CCTTCATTACGACGTTTGCACGCAGAAAAAAACCATTTTTATGTTTGGAATAAAAG
TTAAACACCGGAATGAAAGATTCAAACTTATGCTCTATTCTGATATATATAATATAA
AAGATTCAATTGGGTTGCTCTAATCCCAACATCCTAAACTAATAAAAGAAAAGGAC
CCAATTATATTTTTAGATAATTCAAAAGGACGCCATGCAAACTAAAAAATCATCAC
ATTATAGAAAGGTAATAGTTTAAATAAATAGTAAGAAACCTCTCAATCATTCACTTA
ACATTTAAAGATCGATTCATGTTTAAATTCTTGGGGAGTTAAAGTGATGTGATATAA
AGAGAAATAAACTTTTATATATGAACAAATATTAGCGGGTCATAACACACAACATA
ATTAAATGGAATCATAATAAAATAGAATACCAAAATATACGTGGAAAATCCCTTCA
ATATGAGGATAAAAATCACAGGACAAACTAGAGATAATCCACTATAATAATAATAA
ATATACAAATCTCAATCTCTTACCTAAAACCTTAGCAATAATCACAAAAGAATAACT
GGGATACAAGGATCACATCACTGTGCACAATATCTAAATCCTTCATAATTCTCCCGA
GTAATTATAGTAAGAATCTATTATAGATCTGATCTAATCTGAGATGAAAGCACTACT

| SEQUENCES |
|---|
| AGATGATTGAGAATAGTCTCTCTGTATTCACTTTGTTTTCTTTTCTTTCTTTCCCTTTC |
| TTTCCACGACCCCCTTGATATAAATATGTGTTGTCCTTGTTCTTGTCTCTCTGTGAGCT |
| TGTGAGCTTGTGAGCTGTGGATTGAATATAGGCTCTAAGCCCAACATAAAGAACTGA |
| TGGTTGCGTGACGCATTGACGACATCATCTGCATCTCCGAAATCTGAGGTCTATCTT |
| CTCCACGTACGATGCCATCACAATCAGATGTTAGAGTTCCTTACGAACATACAATAA |
| AGATCGAGTTCTTTCAAATGCAAACACTAAACCACAACTCTCTTTTTCTCACGTCTGA |
| ATTATCCGCCTAATTTAAGCATAACGTATGAAGAAAATTGTGCCCAGCATAAAAATA |
| ATGATTTAAAAGATTTCTTGGCACATTTAGATTCTACAAAGTATACGATATCATGTA |
| ACTAATGAGAATCTGCCTTCGACACGGAAGGCAGCAGCAGCTGAGTTTGGTGGGAG |
| AAAATTGCCGGGTGCCTAAAATTGTATTGGCTGGGAGCCTTCTCTTCACACCACACG |
| CTGTGTTCTGCGTTCCAGGCGTGGGGTGTCGTCACAACCTCGTCAGACTAACTCACC |
| TACTTCTCTCCACCCCGACTGCAATGTTGATTATGGTGAACAATCATGCGTCATCATC |
| ATTTAGGTTCTCTATTACACTCATCTTCTTCGCAAACCATAAATAAGTGAATAGGAC |
| ATGACGAAAGGACGTTTGACGGATTGGAATTGATGTCACGGGAGGACGAATACAAA |
| CACCTGTAGAGATCAAAGATACAAAATAAATACGCGGCGGGGATGGCTATTATGGA |
| ATGAGATAAGCCTGTGGATCTTTTGTTAGTGGCTATTTATATGTGGCCTTCTCCACTC |
| TTCTTCTCTCAGGAGAAGATATCTCAGAGAGAGAGAGAGAGAGAGAGAGGGTATAA |
| CATATAGCGGCGGCAGCTATGGAATGGTCTGAAGAGGTCACGCCCCTGCACTTCATG |
| GTATGCTTCGCTTTACCTTTGGTGCTCCTGTATGTTGTCGCTACGAGAAGACGAGGG |
| AAGCTGCCCTTTCCGCCGGGGCCACCGCAGCTGCCCGTCATCGGCAACATGCTGATG |
| ATGGACCAGCTTACACACCGCGGCCTGGCGAAGCTCGGGGAGCACTACGGCGGCCT |
| CTGCCATCTCCGTCTTGGCTTCCTCCACGCCTTCGCGGTGTCCACGCCGGAGATCGCT |
| CGACAAGTGCTTCAGGTGCAAGACAACGTCTTCTCCAATCGCCCGGCCACCATCGCC |
| ATCTCTTACCTCACCTACAACCGCGCCGACATGGCCTTCGCCCACTACGGGCCCTTC |
| TGGCGCCAGATGCGCAAGCTCTGCGTGATGAAGCTCTTCAGCAAGAAGCGCGCCGA |
| GTCGTGGGCCTCCGTCCGTGAGGAGGTCGATGTGGCCGTCCGCTCCCTCGCCGACCG |
| CGCTGGCTCTGCTGTCAACGTCGGCGAGCTCTTGTTCAACCTCACCAAGAACATCAT |
| CTTCCGGGCGGCGTTCGGGACGCAGAGCCACGAGAACCAGAACGAGTTCATCTCCA |
| TACTTCAGGAGTTCTCCAAGCTATTCGGCTCGTTCAACATCGGGGACTTCATCCCAT |
| GGCTCAGCTGGATGGATCCGCAGGGCATCAACAAGCGGCTCAAGGTGGCACGAGCG |
| TCGCTCGACAGATTCATCGACAAGATCATCGACGAGCACATGGCGAACCGCAAGGA |
| GGCTGATGCATCCGATGCTGACATGGTGGACGACATGCTCGCCTTCCTTGATGAGTC |
| CGGCTACCGCTGCCAAGCAGGGGAGAGAGATGATCTCCAGGGAACCCTCAAGTTGA |
| CCAGGAACAATATTAAGGCCATCATCATGGTGTGCTCCAATATCCTATCGATGTCTC |
| CCTACTTGGTTCACTTTCTTTGCTCCTCTTCACGCAATACAATTAGATAATCTCACAT |
| CAGAATGAGCTCTCTCTCTCTCTCTCTCTCTCTCTCTCTCTCTCTCTCTCTCTCTCTAT |
| CTATCTACACACACACACATACCCAGAGCATGATGGTGATGCACGACATCATCAAA |
| AGATAGCAATTTTTTCCTACCCAACCACACTTTAGAGTTATTAAAAGCATGATATTTT |
| AATTCAAAGTAGTAATTATTATTTATTATGTTCTTCTGAATTCTTATATGATGGTTGT |
| TTGAATTTGCCTCAATAAACTCAATTGCTTGACGACGCAGGATGTGATGTTCGGCGG |
| CACGGAGACGGTGGCCTCGGCCATCGAATGGGCCATGGCCGAGTTGATGAAGAGCC |
| CAGAGGACATGAAACGGGTGCAACAAGAGCTGGCTCATGTGGTCGGACTCGACCGG |
| AAGGTGCACGAGAGCGACCTCGACAAGCTCTCCTTCCTCAAGTGCGTCACCAAGGA |
| AACGCTCCGCCTCCACCCCCCCATCCCTCTCCTCCTCCACGAGACCGCCGAGGACTG |
| CGAAGTCGCCGGCTACACCGTCCCCGCTCGCTCCCGCGTCATGATCAACGTGTGGGC |
| CATAGGCCGGGACAAGTCCTCATGGGAGGACGCCGACGCGTTCCGGCCGTCGAGGT |
| TCACCCCCGGCGGCTGCGCCGCGTCTCTCGACTTCAAGGGCAACTACTTCGAGTTCC |
| TACCCTTCGGGTCGGGCCGGCGCTCGTGCCCGGGCATGCAGCTGGGCCTGCACGCGC |
| TGGAGCTCGCGGTGGCGCAGCTGATCCACTGCTTCACGTGGCGCTGCCGGACGGA |
| ATGAAGCCCAGCGAGCTCGACATGGGGGACGTGTTCGGGCTGACGGCGCCGAGGGC |
| GGTGCGGCTTGCTGCCGTCCCTGCACCACGTCTCAGCTGTCCACTATACTGATCACT |
| CTTCCACAAAGAATGAGAGCGACGCGTTGGTGGGTGTGTTTATCTTCTGCTGTTCAG |
| ACAATAATAATGCTTTATTCTATATGAAAACATATATATATATATATATATATGCAT |
| GAAATATTTTGTATCGGAGATTGCTTCGATGTACACCACAGAATAAGATCACTGATT |
| GTTGATTGCAGCTCATTGCGGTGTTTTCCATTGTCTCATGGTGGACTAATACATCACA |
| AGTATAAGAAATCGGCCACATTGGTCGGAGGTCAAATCGCATCCGCATATGCGTCCT |
| TATTTAAAGTCTTTGGTTTCGCGTCAACTCCACTAGCATATGTGATTAATTATATATA |
| CCTTCAAAACCTGTGATAATTTATTTACATCAATACATCCCTTCAAAACCTAAAACTT |
| AATTCTGTATCACTATAATTGATGTCTATCAGCCGCTCTTAGTTAAATTTATAATTTC |
| TAGTGTTATCTTTTAGATACTTATTATGATGTTACAAAATATTAAAAGTATTTTAAAT |
| CATATATTTGTTTTTATTTAATCAAAAAATTAATATGAAACATAATTTTTACCTTAAA |
| AAAATATTTCATTTAGGTCATGAAATTTACATAAGACCTATAATTAATTGATGATTG |
| ATAGAAAATACATTATCGATCAATCTAACATGTGACAACCATGGTCTAAGGCAGAT |
| GATTATGTATTGTCTCTCCCTTATCTCTTGCATCGATAAGAGATCAAGGGGAGGCTA |
| TTGGAGGTAATTAAAGGTTACTTCCCAACAGAATATTCTGTCTATTTATAATTATGTA |
| TAAAAGCTCATATTCAACATAATGAAAAAAGATGAAGGATAACCTTTTTGACCACTT |
| GCATTCGTACTCATATATCTCGGGTTACTAACTTGAGTGTTAAAAAGATCGGGTTAT |
| AAAACCTCTCTCAACCTCGATCTTTGTATAGGTGGCACCTCGAGAGTTTAATGTTTTT |
| ACCTCAGAGGCACATCGGACAACCGTACGCATACGAGCCTAGACTATATTGGATTA |
| ACCAAGATGTCAATAACTTCTTCCTGTAATATTTTGATACTAGAAGAGGACTTGATG |
| TCGTAGAAATGCCTATCCATCGATTCTCTTAATAAATGCTCGAGTAAAGAGACTTTG |
| CCCTCAACTTATAGTACTTTCACCTAGGGGGACAATAGACACCCTTTCTGCACATGG |
| ACATATTCACCTCAGTGTGAATGCTAATACGATACTAGCGTCTATTCAATGACCAGG |
| GTCTCTCACCCCTAGGGATTGTTAGGATCGAGAGCACTAAGAGGGGGGGGTGAAT |
| TAGTGCAGCGGATATTTTTCAGCGATTAAAAACCGAAAGCTGCGTTCGTTCGATAAA |
| GACTATTTTGATGCAAAAGCCGATTCTAAGATTACTTATGATTAAGTGCAGTTTAC |
| GTTTAAACACAGTTAGCGTCTAAACGCAGTTTGCGTCTAAATGCAGATTGCGTCTAA |

| SEQUENCES |
|---|
| ACTCAGATTGCGTCTAAGCGCAGTTTGCGTCTTAGCGCAGATTGCGTCTAAGTGCNN<br>NNNNNNNNNNNNNNNNNNNNNNNNNNNNNNNNNNNNNNNNNNNNNNNNNNNNNNNN<br>NNNNNNNNNNNNNNNNNNNNNNNNNNNNNNNNNNNNNNNNNNNNNNNNNNNNNNNN<br>NNNNNNNNNNNNNNNNNNNNNNNNNNNNNNNNNNNNNNNNNNNNNNNNNNNNNNNN<br>NNNNNNNNNNNNNNNNNNNNNNNNNNNNNNNNNNNNNNNNNNNNNNNNNNNNNNNN<br>NNNNNNNNNNNNNNNNNNNNNNNNNNNNNNNNNNNNNNNNNNNNNNNNNNNNNNNN<br>NNNNNNNNNNNNNNNNNNNNNNNNNNNNNNNNNNNNNNNNNNNNNNNNNNNNNNNN<br>NNNNNNNNNNNNNNNNNNNNNNNNNNNNNNNNNNNNNNNNNNNNNNNNNNNNNNNN<br>NNNNNNNNNNNNNNNNNNNNNNNNNNNNNNNNNNNNNNNNNNNNNNNNNNNNNNNN<br>NNNNNNNNNNNNNNNNNNNNNNNNNNNNNNNNNNNNNNNNNNNNNNNNNNNNNNNN<br>NNNNNNNNNN |
| SEQ ID No: 90<br>>Banana_XP_009384087.1<br>CTATCATAAGTTAAAATCCATCTATCAGCGATCTTAACTTCGAATCTGTCA<br>TAACCTTCAATGTGGTGGGCTAATCGATCAATAGTCTCATTGTCCATAAAATTGTTA<br>GTGCTACTATTATCAATCAAAACTATAACATGCTGATGTTCTAGAGTTCCGCCAACT<br>TTCATAGTTTGCGGGTTAGAATAATCGGTTAATACATGCATTGTATTATGGTATGCCC<br>AACATCTTCGTTAGAATCTATACCTTCATGATCAGAGTCCACATTCTTAGCTTTTGGT<br>TCCTCTCCAATTGGTTCAATCATCAAAAGTTGCCCTTATTTACATTGTTACTCCATAC<br>TTCACTTTTCATCATAATACAAACCCATTTGGAATCTTTCATTGAGTTCTTTTTGGGTT<br>AGTCTTCGGGTGTCAGAGTTTTGGTTAGCCGTAGCGGAAGGGAACGGACGTTGGCG<br>CAGAGTGGCAACACCAATGATGAATTGACAGCGAGAAGAGAGCTTGCTCTAGGCAA<br>GCGGCTCTGATACCATGATAGAAATAATAGAAGATAAGAACAATAATTGAAGAAGC<br>TTTATTGTAGAAATAAAATAGCATTAGCTTGAATCTATTAACATGTTCCCTCTCCTAT<br>TTATACAAATTAGGAGGAAGGATTTCCCTAACAGACTAAACAGAATAGAGAGATTT<br>CCTCATATAATTGGGGAGATCTTATCCTTTATCAAGTTGGGGAAATCTTTATCTTCTA<br>TCAGTTACTTGCACTCGAGGGTTCTAATTCGAAGTGATTGGTTAAATCCAACTCATG<br>CGACATTTTTTTTCATCTCAGAAAGAGAAAACAACATTAATTATTGGTGGTGAGGTC<br>TTGGATTGATTCCAACTTACTTCAACCACAAAAAGAATGAAAAGGAAGAGAGAAAG<br>AATCCCAAATTAGGTTCATGAAGAAGAAAGAGACTCTACCTCTCCCCCTGTATGT<br>CATTTTATTAGGTTATGAACCAAATCCTTGGTTTTCAGTCCCAATCAGTGAAGGAAA<br>ATAAGAAGAATGAAAGAAGCAGATAATGATCAACTTGCATCTTCCAAGCTAAGATA<br>AGAACTAGCAACCAGAATTCATTTAAAAGCGGATATATTTTGTTTATGCATCTACCA<br>TCGATATTGATGTAACAGCTATTAAATAAGAACAGGCAAAACTTCATCTTCGATGGT<br>ATTCTTTGACATCAAAACATTATTTTTACCCTTCTGATCGTGTAAATAGCTTAGAGAA<br>CATGACTGTTCAGCTACAGGTTTTTTTAGCATCAAATCATTTGCCAGGATTCAAACA<br>ACATTTTCTTCAAAGATATACGTTCTTTAATGATTCTTTCTTGTTTCAGAGGACACCA<br>GCATATTGGACTACAAGCACAAGTGAACTTGTACTTGATGCTTAATGTATCGACTCT<br>TGTGGTCAAGCACTAATAATACCACGATCCAAACATGTATCCTTTCTCATCAACCGA<br>GTCCACATCTGAATCAAGATTAATTTTGCGTGGTAAGAGATATGATCTTGTCTTGA<br>CTCCTTGATACCATCAATCAGATTCCCAAAGGCAGTGGAATGACTACGTGAGCTGCC<br>ATTTCAATCCCTGAACACCAGAAACTAAAGGACAAGGCAGGAAAGAAGTAGATCGA<br>TCCTCTGTGTTACTTCTCATGTGCTGTGCTCACTGATAAGGTAGGTGACATGCAAGT<br>CTTGCCTGCACTGCTCAGGTGATGCTACTCGATCCAAATTGGGTGAAGAAAACAGCA<br>AGGAGGGTGGAATGAGATGGAGCAGTTGCTAAGGCCTGTTCATGGATGCGCAGATG<br>GAGTTTGGTGGGAGGAGGTAACTCCATTCCTACGTCGTCTTCAACCTACCCCATTTA<br>AATACTCTCCCCTTCTACATCTATGGCGTCCCTACGTCCCCCCACCCTCACCAAGATG<br>TACTTAGTGATACCTCATTGAATTGATTGCAGTGAGAGTCGCGTAGTCTTCTGCGTC<br>AGTGGCTATATATTTGGCCTTCCCCTCCGTTGTACTCTTCGGGGTAAGAGACAAGTG<br>ATCGCTTTAGACGATGGAATGGCTCGAAGAAGTCACCTCCATGCGCTTCGTGGTATG<br>TGTTGTGGTACCTGTGACGTTGCTGCTTGCTGCTTCAACGAGGTGGCGGCGGAAGCT<br>GCCGTTTCCGCGGGGCCGACGCCGCTGCCCATCGTCGGTAACATGTTGATGATGGG<br>CCAGCTCACGCACCGCGGCCTCGCTAAGCTGTCGGAGCGCTTCGGTGGACTCTGCCA<br>TCTGCGCCTTGGCTTCGTCCACGTCTTCGCGGTGTCGACGTCGGAGATAGCCCGGCA<br>AGTCCTCCAGGTGCAAGACGCCGTCTTCTCCAACCGCTTCGCCACCATCGCCATCAC<br>CTACCTCACCTACGACCGCGCCGACATGGCCTTCGCCCACTACGGCCCCTTCTGGCG<br>CCAGATGCGGAAGCTGTGCGTGATGAAGCTCTTCAGCAAGAAGCGCGCGGTGTCGT<br>GGGCCTCCGTGCGCGAGGAAGTCGACGCGGCCGTCCGCGCCGTCACGGACGGCGCC<br>GGCGCCGCCGTCAACCTCGGCGAACTCATGTTCAACCTCACCAAGAACATCACCTTC<br>CGGGCGGCGTTCGGGACGCAGAGCCACGAGAACCAGGAGGAGTTCATCGCCATACT<br>TCAGGAGTTCTCCTTGCTGTTTGGGGCGTTCAACATCGGCGACTTCATCCCGTGGGT<br>GAGCTGATGGACCTGCAAGGCATCAACAAGAGGTTCAAGGTGGCACGAGAAGCAC<br>TCGACGGCTTCATCGACAAGATCATCGAGGAGCACATGGCCAACCCCAAGGAAGCT<br>GACGCAGAGGATTCCGACATGGTTGACGAGATGCTCGCCTTCTTCGAGGAGTCCCGC<br>GACCGCACGAAGGAAAACGAGGCAGATGAGCTCCAGAGAACGCTCAGGTTGACCA<br>GGAACAACATCAAGGCCATAATCATGGTATGTGTCCATGCATAAATATGAACAACA<br>CTACATCTAATTTATGGGAGGAACATTTCATGAACTTATCCGTATCAAACTTGTGAT<br>CGGTTCATCCTTTGCTTCAATCACTCACTTCTCAACCAAGAACACATGCGGCTGTTCG<br>ACTTGGAATCGATAGACTGATTGCTGAAGTGCACAGGATGTGATGTTTGGCGGCACG<br>GAGACGGTGGCGTCCGCCATCGAGTGGGCCATGGCGGAGCTCATGAAGAACCCAGA<br>GGACATGAGGCGAGTGCAAGAGGAGCTGGCCAGCGTCGTCGGGCTGCACCGGAAG<br>GTGCGCGAGAGCGACCTCGACAAGCTCCCCCACCTCAAGTGCGCCGTGAAGGAGAC<br>GCTCCGCCTCCACCCCCCATCCCCATCCTCCTCCACGAGACCGCCGAGGACTGCCA<br>ACTCACCGGCTACGCCGTCCCCGCTCGCTCCCGCATCATGATCAACGTGTGGGCCAT<br>CGGCCGCGACAAATCAGCATGGGAGGACGCGGAAGTGTTCCGGCCGTCGAGGTTCG<br>CCCCCGGCGGCGAGGCGGCCGCGCTCGACTTCAAGGGCGGCTGCTTCGAGTTCCTGC |

-continued

| SEQUENCES |
|---|
| CCTTCGGGTCGGGGCGGCGGTCGTGCCCGGGCATGCAGCTGGGGCTTCACGCGCTG |
| GAGCTCGCGGTGGCTCAGCTGACTCACTGCTTCAGCTGGGAGCTGCCCGACGGAAT |
| GAAGCCCGGCGAGCTCGACATGGGGGACATGTTCGGGCTCACAGCGCCGAGGGCGG |
| TGCGGCTGGTGGCCGTCCCTACGCCACGACTCACCTGTCCACTGTACTGATGGATCA |
| CCCCGTCCATCCATGTTCATCATTTCCAGTGTTTCCGGAAGAACCAAGACAGGATTC |
| GTACGCATGCCATGTCTGTGTGGGAGATTGCTTCTTGGTCAACATGGAATCCATGTT |
| GCAGGCAGCAGAAATAAAGATGTATGATTGTGTCTCATGTGTTTTGGTGGAACAAGC |
| AGTGTGTCTCATATATGTTATCTGTCTCATGTCAAATAAATAGACTTTAAGGCACTAT |
| TATTCTTAAGTCAAGCTTTTTTTTGTTATATTTTGTTGAATATTTAATTTATAGATTAT |
| TTTACCAACAAAATATAAAACATATGTAGTGCTACATATCCGATTACATTTCACATC |
| TCTCAGTCCAAAAGGAGAAAAGCTTAGACATCTTTCGAAGAAGATTTGCACTGTAAT |
| CGCTGCTGTGTGATTGTGATGGACATGTACAAGCGTGCCATCAGCAACAGAGGAGG |
| AGCAGGCGGATGTCAAAGAATGGCCAAGTTTTGGGAATGGCTTAGGACAGTACGAA |
| TCTGCTTCTGCTCTTTCGGCAAAGGTGGGCGCCGGCGGCGGCGACCCGGGTTCGGAC |
| GCGCTCGAACTCTGCGGCGGGGCAGGGGATGGTGATGCCGCCGGGGTGGTGGAATC |
| CGAACTCCTCCTCCCGCCTCCTGCAGCAGCTCCCCGAACAAGGGGTGGTTGAAGTAGA |
| TCACCGGAACCACGTACCTCCGCCCACGTACACCGCGATGTGCCCCTTGGGCGGCCG |
| CCTCTGCTCCTCCAGGAGCGGAGCCCGGTCGCCGAGGTGGGGTCTGCGTCGTAGGA |
| GGCGGCAGATGCTCCGGCCCCAGTGGGCGAGCCTCGTGGTAGCCGTGGAGCTCTCC |
| ATCAAGGGCCGGGTGTGGTCACGACGTCGGCCGAGCCGCGAGACGCATCGCCATAT |
| CCTCGAGAGACGGCGGCCCAACCTGAACCCTCCTTTGTGTCTCTTCATAATATGGAG |
| AAGGTGCATCAAAACACACCCATTCCTTCTCTTTATGCACTGCACGAGAGATCCAAG |
| AAGAGAGAGTCCGATGAAGAGGTCAGAGAGAGGAACAGTGAAGGGAGAAAGAGA |
| GATGGCGGAATGAATATAAAGAGGGCTGGTCAACGGTATTATATATGTATATATAT |
| ACATATCAATTGGGAATTGAGTACGGAAGAAACAGAAGAAGGCGGCGGCAAGAGG |
| AGACGTGAGAGTATGGAGATGTGAACCGTGAGTTGGCTGCACCGTAGAACACACGG |
| CCTGATGAGCTACACAAGCGTCGCGTGGCGGAGAAGAGTGTGGTGTAAACGCAAAC |
| GCAAGTGGTGGTGGAGAATCCCATGACAAAGACTTCACATTTGTTCTACCAATTGTCT |
| CCGTTCTCCATCGCACGCTGATTTGAATGGGGAATTGGAGTGGGAAGAAGCATACTT |
| TTCTTGTGTGCATGTATAACATGTTCACTCGGTGAAAGGGAAGCGAAGAAGAAGAA |
| GAAGAATCAAAGAAGTTGCTCGTTGGACTTTAAAACCATGTCGACTGTCAGTAATGT |
| TGATTATTATGTATGCGTCGACGACTCATTCCCCACTTAAATGTATGCAACCATCGGT |
| AGCTGAGAAAGGAGAAAGGATAAGTGCACTGCTTGTGGCAGTGGCGAAGGGATCG |
| ATGGTGAGATGAGCACCTCCTCTCATCTAATTCGGAATTAGAAGAGTACTGCACCGG |
| GATGGCCGGAGCTCGTTACTCTTTTGTGGTCAATCAACTAATTGTTGATGATGTGTAC |
| TTACTTCCATAGATTTGAGTTTAAAGTCTATACACATACTTCGATAATAATTAGTATT |
| ATTTACATAGTGTAGTTAATCAAGTAGAACATTATATCACAAGATCGATATTTTAGG |
| TGCAAATTTTATAGAGTGAGATTTTGATGACTCAATATAAAATAAGTGAGTCAAAGA |
| TACCNNNNNNNNNNNNNNNNNNNNNNNNNNNNNNNNNNNNNNNNNNNNNNNNNN |
| NNNNNNNNNNNNNNNNNNNNNNNNNNNNNNNNNNNNNNNNNNNNNNNNNNNNNNN |
| NNNNNNNNNNNNNNNNNNNNNNNNNNNNNNNNNNNNNNNNNNNNNNNNNNNNNNN |
| NNNNNNNNNNNNNNNNNNNNNNNNNNNNNNNNNNNNNNNNNNNNNNNNNNNNNNN |
| NNNNNNNNNNNNNNNNNNNNNNNNNNNNNNNNNNNNNNNNNNNNNNNNNNNNNNN |
| NNNNNNNNNNNNNNNNNNNNNNNNNNNNNNNNNNNNNNNNNNNNNNNNNNNNNNN |
| NNNNNN |
| |
| SEQ ID No: 91 |
| >Banana_XP_009411495.1 |
| AACCAAACTACATACACATTGTTGACACTTTTTTTTATCATTGATAGATCA |
| CTCATCAGGTGCAGTATGCCTTGTAGATATAATATTTCTACTTTGTCAGCATTGTTTA |
| TTCTGATATAGCTAGTGATATGGTCATATTCACTTCCATATTGATTGGAAAGTTGGA |
| AAACCAAGTCCTAGTAAGAGTGAGCCCAAAATATGATTCCTCTCTTAGAGACGCCCG |
| TGCAGGACACTGTCGATGCATGCTAGTTTTCTGTCCATATAAAATTAAAGTCCTGTG |
| GATGAATCATAAAGGTCACCTGTCATATGGCCATGGGTTTTCAGTTTCTGTTTCTAGA |
| ATTTGTAGTACAAAACAAAAACCTGTAACTTTCGAGCATGTTTCCTATCATCATTCTT |
| TTAGTTTTTTTTTTTCCTTTTCAACAACAAAAGGTAAGAGTCTGGTGCTTGTTAGAAA |
| GTACGGCATGCGCATCTGCCCTCTTTCATATTTTTGAAGTTTAAATTTAAATGCTGTC |
| GAGCGATGTCCCGTCATTTATTACCATTTGATCTGATTTTTGACTTACAGGTGTCAGA |
| TAATGGCTGGGCTGAAGGTGAATGCAAAGGAAAAGCAGGTTGGTTCCCTTGCGCAT |
| ACATTGAGAAGAGGGAGCGTGTGCTTGCAAGTAAAATTGCTTCAATGCTATAGAAG |
| TGTTGCTTTGCACGAAGTGTGCATGTTGCAGTGTTGGGCTTCCATAAGCCGAAATAT |
| CGTGTTTGTGTCTATGGTGTTTGTATCTTCAACTTATTTCTTGCATTTTCCCCCATCTT |
| ACGGTTTGTTTAAATGGCCAATGCTGTCTGATATCTTTGTCAAAGGTTAAAGTAGAT |
| TTTGCAGGAAAACAAAGTTATTTAGTAATCCACCACTTAAATTACTGGCTTTGATTA |
| ATATAACTACTGTGGAATATGCTGCTGGCTGCAGCCAAATAAGATATGCCACGTTGC |
| AAGCTATTGAGCTCTAAATTGAGTGCTACCGGTGCCAATGGTCCTCTTGGTCGGAT |
| GCAGTGGACATATAACCAGAGATAATTTGTAGTTTTCTGAGCCAGGTTTTTCTTTATG |
| TTCTTTACATTTTTTGCTTGCTTTTTCGTCTCTCTCTCTCTCTCTCTCTCTCTCT |
| CTCTCTCTCTCATGATATATGTGTGACTCGTTTCCAAATGTATTTTGAGTTACAGT |
| CACAGTCCCGTATTATTCTAGTTACATTGCATACAAGATGATGGTTTAACCTTGAAA |
| GTCTAACTCATTAATCTTCATTTGAATCCAATGACACGTAGGTTTTGCCAGGATCTCA |
| GTCTCTTCCCCTTGGAGGAAGTCTTGCAGCAAGAGGCAGAACGAAGGAATAGTTCC |
| AAGAGGTAATGTTGTCGAAGATTCTTTCCTTTTTGATTTGCGATGGCAAATATATCAT |
| TTCATTTCACTACCACTGAGCTGTTGCTGCCTGCGACAACTACTAGGCTCCGTTATTT |
| ATTGAGGTGCGTGCGCCAGTGGGCTCATTAATAGTATAAGGATATCCATGCTTTCAG |
| AATTGCTTCGTGTCGTGGCTCAGTTATCATTATCTTTCTTCATTTTTTATTGTCTTTGT |
| CCATGCTTTCAGAATTGCTTCACGTGGTGATGGCTCAGATATCATTTTCTTTCTTTAT |

-continued

| SEQUENCES |
|---|
| CTTTTTTTTTCTTTTCATTTTTTTATTGTCTTTGTCCATGCTTTCAGAATTGCTTCACGT |
| GGTGATGGCTCAGATATCATTTTCTTTCTTTATCTTTTTTTTTCTTTTCATTTTTTTATT |
| GTCTTTGTCCATGCTTTCAGAGTTGCTTCATGTGATGATGGCTCAGATATCATTTTCT |
| TTCTTTTTTTTCTTTTTTTTATTGTCTTTGTCCATGCTTTAAGAATTGCCATATCATTT |
| TCTTCCTTTTTTTTCTTTTCATTTTTTTAAATTGTTTTTGTCCATTCTTTGAGAATCG |
| ATTCATGTCGTCGTTGCTCCGATATCATTATCTCAATACATTTATCGAAGTAAAAAA |
| AGAAGCTATGAGCTGATTGAATCACCTTGGCGTTTTCCCAAGGGTTGAGGTGGGCGT |
| GTCACTAACCTGATTTGTGGAACCCGTTCGTTGGGTTCCATCACGTGCCTCCAATGTC |
| ATGTCGGTGAAAGCCCACATCGACCATCATTCTATAAATCTGCACTCACTCCCTCTA |
| ACGGTGACACAACTTTCATCAGCACAGTATGGTATGGGTCGAAGAAGTCACCTCCAT |
| GCACTTGATTCTACTATGTTTGATGTTACCTTTGACACTCCTACTTATTGTCAACATT |
| GCCGCAAGGAGGCGGCGGAGGCTTCCCTTACCGCCGGGGCCAACTCCACTACCCAT |
| CATAGGTAACATGTTACTGATGAACCAACTCACCCACCGCGGCCTCGCCAGGCTCGC |
| CAAACTCTATGGCGGCCTCCTCCACCTTCGCCTTGGCTTTGTCCACCACTTCGTGGTG |
| TCCACGCCGGACGTCGCCCGACAAGTCCTCCAAGTGCAAGACAGCGTCTTCTCCGAC |
| CGCCCGGCCACCACCGCCATCGTCTACCTCACCTACAACCGCTCCGACCTGGCCTTC |
| GCCCAGTGCGGCCCTACTGGCGCCAGATGCGCAAGCTCTGCGTCACGAAGCTCTTC |
| AGCCGGAAACACGCGGAGTCGTGGCTCTCCATCCCTGAGGAGGTCGATGCGGCCGT |
| CTGCACCGTCGCCAAGCACGCCGGCTCTGCTTTCAACGTCCGCGACCTCGCGTTCAC |
| TCTCACCAAGAACATCGTCTTCCGGTCGGCGTTTGGGAAGCGGAGCGGAGCGAGAACC |
| AGGAGGAGTACATCGCCGTCGTCCAGGAGATCGCCACACTCTTGGGAGCCTTCAGC |
| GTGGGCGACTTCATCCCATGGCTTAGCTGGATGGATCCGCAGGGCATCAACAAGAG |
| GCTGAGGGTGGCACGAGCGACACTCGACCTCTTCATCGACAGGATCATCGATGAGC |
| ACATGGCGACCGACGCCGCCAACGCAGACATGGTGGGCGTCATGCTCGCATTCCTC |
| GAGGAGTCTTCTCACCACCACCGACAAGAAGAGGGAGATGATCTCAAGGGAACGCT |
| CAGGCTGTCGAGGGCCAACATTAGGGCTGTAATGATGGTACGTATACATACGCTCTA |
| AAAAGTAATACTATTTCCTCATTCTCTGTTACTGTAACCTGCTAAGCTATATATTTAT |
| CTCCACATTGATATGGTTTCCATGTGCTTCGTTAATATCTCGTTGCGTAATTAAGACG |
| ATTAAATTCTCATTTTTCTAACCTGTAAACCGTATCATCTCTAATTACGCAGGACGTG |
| ATGTTTGGCGGCACGGAGACGGTGGCCATCGCCATCGAGTGGGCCTTGGCCGATCTA |
| CTTACCAGCCCTGATGACCTGAAACGAGTGCAAGAAGAACTAGCCATGGTTGTAGG |
| ACTCGACCGGAAGGTCCACGAGAGCCATCTCGACAAGCTCTCCTTCCTCAAATGCGC |
| CATAAAGGAGACGCTACGTCTCCATCCCCCGTTCCCTCTCCTCCTCCACCAGACTGC |
| CGACCACTGCGAGGTCGCCGGCTACTCCATTCCTGCTCGGTCGCCAGTCATGATCAA |
| CGTATGGGCCATCGGCCGCGACGAGTCGGCATGGAAGGACGCCGACGCATATCGAC |
| CGTCACGATTCGCTCCCGGCGGCGACGCGGCCGCTCTGGACTTCAAAGGCAACTGCT |
| TCGAGTTCTTGCCCTTCGGGTCCGGCCGGCGGTCCTGCCCGGGCATGCAGCTGGGCA |
| TGCACGAGCTGGAACTCGCGGTGGCGCAGCTGCTGCACTGCTTCACCTGGGCGCTGC |
| CCGACGGCATGAAGCCAACCGAGCTCGACATGGGGGACGTGTTCGGGCTGTCGGCA |
| CCGAAGGCGGTGCCGCTCGTGGCCGTCCCCACACCCCGACTCAGTTGCCCACTGAAT |
| TGATCGTCTCTTTCTTGGATTTGGTTTCCACGAAATAATGAAATAAAGAAGCGGAT |
| TTCGGTAGCTTTCCACTGTACACACCATTAAGCTTCCCTCTGTTCGCAGTGTTTCATA |
| TATGCAATAAATGAAGAGCTTCAGCTCTTTCCTGTAATACCCTCTTCATCAGCTGCCA |
| AGAGTTACATAATGGTGATCGCCATTAGAGATATAACTCATACAGACATTTATCGTT |
| ATCATATAATGGTGAGATCAGAAATGTTGTCTTCGCTCCTGTTGTGGGGAACAACCT |
| TAAGCCATGGCCTCGGGGCAACGTGGCTGGGTTCGGATCCGAATGATCGGGGATC |
| TTGCTGAGCGACCCTTGAGACTAGTGAGGTGACCGACTGCAGTGGTCCGATTACGAC |
| AGGACGGTCGTTTCCTCTGGAAGGAAACTCCTCGCCTGGGTACGCGATGGGAGGTG |
| CTTCGTCTTCGTCCCTGCACACAGGTCGGGTCGGGAGGCTCGACTTGACCCTCCGAC |
| GATCAAGTCAGTGGATAGTCTTAGGGGGTTTTTCTCATCTTTTTTCCCCCTTCCTTGA |
| GCTGAATGCGAGGGTTTTTATAGGGAAGCTTATTGTCTCATGATGTGCCCACACTTG |
| CAGGGGGCAGGCCCGTACTTTCGATAGCGTCTGACACCAATGTAGGCGTTGCATGA |
| AGAACCAGGCTTGCGCAGGACGTGGCGTGCCCTGATCGTCATCCTGGTCTGCCTCGG |
| TCAGGCGCGTCAAGTCAAATCGAGGCATGGATCATTATCTTGGAGGAGCTGATGTCA |
| ACGCACGTCCCATCGTTATTACCACTATCAACTCCTATCCAACAAAATAATTAAAAT |
| TATATATTCATTCGGGATCTTTGGTTATTATTATAAATTAAGCTTTAAATTCATGAAA |
| AGACGGATGTAATTTTGGTCAACCACAAATGCAATCATATAATCTTGTTTTGTCTAT |
| ATTTCTCCACTATTAACCGTCATGATCTTATTATTTCGTATTTGCATATTAATTAATTA |
| ATTAATTTATTTATTTTCTTGACACCCAAAAATAAACGCTAAGAGGCGACAAAGCTG |
| ACGTGTGATGCGATCGGAGAACGGTATAAGCAAGGGGGGCAAGAAGTGGTGCGTTA |
| TGGTCCGGCATCTATTGCCACCCAGTCTCCTTCCGAGACCGCGCCGCCCCGGTTGAT |
| CGCCATCGCCACCAGCGAGATCAAGAACTTGCACGGCGGGCCCCGGCCGCGATGG |
| CCCCGTCGTTGCTGAACCCGACGCATCGGTACGCGGCGGGCGCTCTGCTGGCCCTCG |
| CCCTCCGCCAGGCCCAGATCCACCAGACCCGCCCCCTCGGCTACGACGCCCGACC |
| CCGACGCACAGGGCCGCTGCAGCACCGGAAGCGCCACCAGCAGCGAGGGCGGTGG |
| CGACGACCCCGAGCTCTGGACCCACGAGTCGTGCGGCCTTCTCCGCCCCGTCTTCAG |
| GTCCCCCTCTCGTTCTCCTCTCCTTCCTTTCGAAAAACCGTTTCCGAGTCTTCCTTT |
| ATTCTTTCTTCTTTGGGGAAATAGGTTCTTGGATATAGACCCCAAAGCCTGGTCGGG |
| CTTGGAGGAGACTGCGCGTCCTCCATGGCCAAGCATCACATAGGAGCGGTACACT |
| CGATTTCCTTTTGACTCCGTTGATTGTTCTCTTGGTCGAATTGCTTTCTTTATGGGCGA |
| TCGTCGTGATAATCGTAGAAACTGCTTATTAGCTTGCACTACTTGTGAGTTGTGATG |
| GTAATTCTAGCAAGAATGGTCGGACATGCTTTCTCTGTGGGTGATCTAGTGATTATG |
| GGAGAATCTGCTTAATCTTGCCCTAGTTTCTGGTTCTTGTGAGTCGTTAAGGTAATGA |
| TCGCCCGGGAGGATCCAACTTGTTTGCACTGTAGGTGGTCATGGTGATAATGGAAGA |
| ATATGTTAGCTTGCCTGCCCCCATCTTTGGTACTTGTGAGTTGTGATGGTAATGATAG |

| SEQUENCES |
|---|
| CCAAGAATTGTCCGACTTCGTTTCTCTCTGGGCTGTCATGGTGATAATGTAAGAATCT<br>GTGTCAAGACCTGTCATGGTAGCCAAGAAGGGTCTGACTTGCTTTCTTTATAGGCTA<br>TCCTAACCATATTGTAAGAATACGGGTCTGACCGTTCG |

SEQ ID No: 92
\>Banana_XP_009403617.1
ACGAGGGGGAGGGGCGGTACTACGTGGTGATCGGAGGAGTTGCCGGGAA
CCCGGGAAAAGAGACGCTGAGCAACTGGTTCAAGATAGAGAGCTACCAAGGAGTCT
ATAAGCTGGTGTTTTGCCCGACGGTGTGTGATTATTGCAGACCTGTGTGTGGATCTCT
GGGTGTCTACGAACAAGGTGGAAGACAGTGGCTCGGTATCAGGGATGACACGCCAT
TCCCGTTCGAGTTCAAGAGGGCATGAGCTTCGGTACGTGAATACATCTACTGTCATA
CATCTATATATCAATAAAGGAGGCATTGTCTTCGGTTGATGGTGGAGGCTTGCATGC
TTTGTTTGAGTCCCCGCGTGTGGGTATGGGTGTGGTGGATTGGCATTCTCAAACTC
TTTGTGCCACACTCCCATGAATCATAGGTTACCCTCAAACATAGGAGAATGAATCTC
TCTATCAACATGAGTGACTCTTTTCATGCTGTGCAAAAGGATAATAAGTTATAGATT
CTGTCTCATTAGGATATATATATTTCTATTATTATGATATTTAACTTTTTTATAATGAT
GAAATTATTAAATAAAATTAAATTAGCTAATGGTGGGTTACCACCAGACTTTTTCTT
ACAATGTATTCCTGACAAAATGAATTTTTGTCCATTTTCTTTTTAGAGGTCTAATAGA
AAACAAAAAAAAAGGTGTGGAAGAAAATAAAAAATAAACATGGGTTGAGTTGTG
CGGAAGAGATAGATCTCGCGGAGAGTTAATTACATATTACCTCTAACTATCTTATCT
TTAGCTTCTCGATCTATATTCTTATAAGAATTATATTAGGGTTTCTATATCTACAAAA
GTAAATTATTGAGATCCTTATATTGGGTTAGAAATAAAAGAATTTTATTGAATCAAC
ATGATTAATATAATATATCAATGTAATTTTTGAAAGTATAAGGATCAAAATACTAGG
ATAGGATGACAATGGATAGAGAAACATTAGACAGGGTTACCGATCAATAGGGAGTA
AAATGATTGAAATGGGACTCAACAATTGAAATATTTCATGGGTCCCACCCACCACGC
AAATACTGCACGTGTAGAGAGCATACTTGTCTCCCGCCGATGTGATGGTGTTCACCG
TCTCACATCGAATCAAAGGATGATTCTAACAAAGTTGTTCGTTTTGTGCTTAAAAAA
AAAAAAAACAAATCAGTTCTTTGTTAATAAAATTAAGGTAACAAAGATATGAAATCA
AAATAAAAATATTATTATGGACACTGTCACATCTGATTAATGGAAAAATCTTATGTT
ATGGTGGTATGAGATTCGCATATCATGTAGCTTTTTTATTTCCAAGTGATAAATTCTC
TCAGCTTTTATTATTTATTCTTTTTGGAGGTTTCCTTGTTAATTTTATTATTTTACATAT
CAAAGACGATCAACTCTTTGGAATGTAAAATAATAATGAGTTAGTTAGGGCATTTTA
GTATATTATATATATATATATATGTATATATGTATATATGTATATATGTATATATATA
TACATATATATACATATATACATATATACATATATATATATGTATATATATATA
TATGTATATGTATATATATATATACNNNNNNNNNNNNNNNNNNNNNNNNNNNNN
NNNNNNNNNNNNNNNNNNNNNNNNNNNNNNNNNNNNNNNNNNNNNNNNNNN
NNNNNNNNNNNNNNNNNATATATATATATATATATATATATATATATATATATA
ACTGTGCGTTTTCGAAATTACTTAACGTATATATACTTGTAGTGAACAAAAATCTGA
TCACCCTTATACGAGAGCCGTTCATTCTAGTTACCTTTTAATCTCGATCGTTCAGGTT
TTCCCAGAAAAAATAAATATAAAAAGAATATGACTCGATCATATCAGCTGGACGGC
CCCCCCTTTGGGTCACTATAAGGAGCGCCCTCCGGCCACTCCGGGTCCTGCCGACAC
CGCTGTCTGTCGGTCTTCGGTGTCCTCAGCTAGAAGAGGAGCCATGGATTGGTTTCA
CCAACTCTCGTTCATGGTTGCTTCCGTTTTCATCCCACTCGCTCTCTTATCGTTCTTCT
GCATGAGAAGCGGACGAAAGCTTCTGCTGCCGCCAGGCCGCAGCCGCTACCGATT
ATCGGCAACATGCTCATGATGGACCAGCTGACTCACCGCGGCCTCGCGAGGCTTGCC
GAGAGATACGGCGGCCTCTTCCACCTCCGCCTCGGCTCCCTTCACGCCGTCGTCGTG
TCCACGCCGGAGATGGCCCGGCTGGTGCTGCAGGTGCAGGACGCGTCGTTCTGCAA
CCGCCCCGTCACCGCCGCCATCGCGTACCTCACCTACGACCGTGCCGACATGGCCTT
CGCCAACTACGGTCCCTTCTGGCGCCAGACGCGCAAGCTCTGCGTCATGAAGCTCTT
CAGCCGCAGGCGCCTCCAGTCGTGGGCGTCGGTCCGCCAGGAGGTCGACTCTGCCG
TCCGCTTCGCCGCTAGACGGAGCGGGTCGTCCGTCGATGTCGGCGATCTGGCCTTCA
CCCTCGCCAAGAACGTCACCTTCATGGCAGCTTTCGGGGCGCAGAGTCACGGGAAC
CAGGGCGAGTTCGCCGGCATACTGCAGGAGTACTCGAAGCTTTTTTGGGGAGTTCAAC
ATCAGCGACTTCCTCCCATGGCTGCGGTGGATGGACTTGCAGGGCATCGACAAGAG
GCTGAAAGTGGCAAGGCAAGCGATCGATCGCTACATCGACGTGATCATCGACACC
ATTTGGCCAACCCGAAGGAGGCGGATGCGCAGGACGCCGACATGGTTGACGGCATG
CTTGCATTTCTTGGGGATTCTGGTGACACTAACGAGGGTGGCCATCTCCATGGTGAT
CTAAGCCTCACAAGATCTAACATCAAGGCGATAATAATGGTACCTCTCTCTCTCTCT
CTCTCTCTCTCTCTCTGACAGCTCTGCCGTCAATTATAATGCCTTTGCTAGTATTA
GAATCTCAACATAGATTGAGGATATATATGTAGACGAATACACGTTTGAACTCAGA
GATCAGATTTTAGTTTGAGTAATTCTGTGGCATGTCAGTCGCAATCATGTCTTACATG
TCGTCTTCAGAGATGGAGACATCCTCTTCGGCTGGATGTTGGCATTATCTTATGCAA
GCAGGCAACAAAGCCAGCTTGAAAAAGTCATTGAAATTGTTGTATTTGTTGGGGTAA
ACAACTTTATGCCGTGGTCTCGGGACCGACGTGGCTTGGTTTGGGTCGGAATGCGCG
GGGATAGCCGGGGTGGCCAGTTGCGATGGTCCAGGCGGGACGTTGCGTGTGGAGTG
AAGCTTTTCCGCAGTGCCGGGAAGATGCAACCCCGCCCTTGTACCTGCACACAGGTC
GGGTCGGAAGCTCGGCTCGACCCCTCCGACGATCAAGTTAGATGATGTGGAGGGAG
TTTTTTAGTGAAGAAGTGTCCCCCCCTCCTCGTTTAGAACTCGGGGGTATTTATAGGG
CAGTTTAGTATTACCTGATGTGCCTGCCTGCACGAGACAGGATCGTACCTCTGATGG
CGTCTGACNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNN

| SEQUENCES |
|---|
| NNNNNNNNNNNNNNNNNNNNNNNNNNNNNNGTGGGCAAGCCGTCCTGAGGTTT |
| GCTCGGCAGTCTGTGGCCGAGGAGCTCGGCGCAGGCGGGCTGCGGCCAAGGGATGC |
| AACTCAGGTGGGCAAGCCGCCCTGAGGGGGGCTCGGCTGTCCATGGCCGAGCCGTG |
| TAGATTAAGAAGATTTTAAGCCACGAGCCGAGAGGGGGTCAGGTAGATACTGGACC |
| TTGGCTCGAAAAGGGCTGAGGCAGGGCTTGGATTTCTTTTCATGAAGACTACATGGG |
| GTAGCCACCGCGGGTGCTCTAACTCTGTTACGGAGCCCGCGGTCGGGGGCCGTTGCT |
| TCTCCTCATGGCCGCCCAGGCTTCCGCCGCGATGTGCCGGTTAGCGCGCTGGAGCAT |
| CTCTGGCACCGTCGTGGGAGGTTGCTCCGCGAGTGAACAGAGGAATCTGGAAGGTC |
| GCAGGCCGATCATGAACGCCTGCACTAATAGAGAGGAGTGAGTGTCCGGCAGGCCC |
| CGGATTTGCGTGGCAAAGCAATCCACAAAATGGGAGAGGGGCTCATCCTCCCCTTGT |
| TTGAGTCCGAGGAGTGGTGCCGCGGAAGGCTTCGGCCGTACATAGGCCACAAAGTG |
| GAGCTCGAAGTTCTTGGCGAGCCGATCGAAGGAAGCGATGGTCCCGGTCTTCAGGC |
| CACTGTACCACGCGCGGGCTGGACCCCACAAAGTTGTTGGGAACGCTCTGCACATC |
| AAGGCGTCAGAAGTCCCATATAGCGCCATCTGGGCGCGAAAAGTGGCTACATGATT |
| CGCTGGGTCAGCGGTGCCGTCGTAGGCGTCCAGCGAGGGAGTCGGAAATGCGATG |
| GAATCACTTGATCTTGTATTTCGGGCGCGAACGGGGACCCTTGGTGTCCGTCCGCTC |
| CGAGCTCTCCTTTTGACCTGCGAACCTCCTGCTGTACTTCGTCGAGGCGTCGACTAA |
| CGAGGCGCAACTGGGCTCGCAGGGCGTTCGTCGAGTCCGCGGATAGCGCCTCAAGC |
| TCTGGGCGACTCGACGTGTCTTCCGCCTCTCGGTTCCCGGGCTGGGCTGTTCGGTTCC |
| GAGGTGAAGCAGGGAGCTCGGGAAGTGGTGCATGAGTCTGGGTGGGGGCTCCCGC |
| TGCTGCAGAGGCTGGGTTATATGCGGGTCGTCGGTTGGGAGACGAGCGGGATGAT |
| AGTTTGTACCACGCCCGCCAGTGCTCGGACTTGATGAGTGAGGTCGTGGAAGGCTTC |
| GGGCGATACAGGCGACGGGCCGACGGGGTCGTCGGGTGGCGACAAACCCGGGTCGT |
| TGAACAACCGCCAGTAGCGCTCCGATGTCGTGGCAGGGCGTTCGTCTCGGGGTTCAT |
| CACGCATGGGATGTTCTTCTAGGGTGTTGATCGGACGTGACCCCATGGCTGCGGGTT |
| CGCCAGAGTGGATCTACTGATCGCTCGACATTCGGGGCCCTCCTTCTAGCGCCAAAA |
| TGTTGGGGTAAACAACTTTATGTCATGGCCTTGGGGCCGACGCGGCTTGGTTGGGTC |
| CGAATGCGGGGATCTTGCGCGGCGTTCCTCGGGACAGCCGGGGTGGCCGGTTGC |
| GATGGTCCGGGCGGGACGTTGCATGTGGAGTGAAGCTTTTCCGTAGCACCGGGAAG |
| ATGCAACCCCGCCCTTGTACCTGCACACAGGTCGGGTCGGAAGCTCGGTTCGACCCC |
| TCCGACGATTAAGTTAGATGATGTGGAGGGAGTTTTCTAGTGAAGAAGTGTCCCCCC |
| CTCCTCGTTTAGAACTCGGGGGTATTTATAGGGCAGTTTAGTATTACCTGATGTGCCT |
| GCCTGCAGGAGACAAGATCGTACCTCTGATGGCGTCTGATNNNNNNNNNNNNNNNNN |
| NNNNATCGCCCTTGTCGTTGCGTGGAGAACCGAGCTGCCGTAGGGTATGGGCGTGC |
| CTCGGTGGTCGTTCTTCTCTGCCTCGGTCAAGCGCGTTGGGTCAGGCAACGATGAAG |
| TCTTCATCTGAGAGCGGGTGACATCAGCGCCCATCGTGTCGGCATTATTGCCCTCTTT |
| CGGGCAGAGTGTCGTCCAGCCATGACTGACGTCGTGGCGCGTCATGTCGCTATTATT |
| ACCCTCGTCAGTATTGATCTATACGTCCAAACACATGGAAATATAAACTGTTGGAGG |
| TCGCACTCTAACGTGGCCTTCGTTGGCATATATGGCTGCATGCCTACGTATCTTTTTT |
| CTTTCTTCCTCGCAGCGTTTTAAACGACAAAGAACGATAAAATAGTCGAATTCCCTT |
| CAAATTACATGAAATTGAAATAGTATCGTTGTGTTCGCATATATTTTTTGCACGGAT |
| ATCATTTTTGTTGCACACATACAAAGCATCTGAGGATTATACTAAGGTCGTACTGCT |
| TCTATATGCATTCATATGAGGATTGCAATCTGTACGTGACACACACAGGATGTGA |
| TGTTTGGTGGGACGGAGACGGTGGCGTTGGGCATAGAGTGGGCCATGGCGGAGCTA |
| CTCAAGAGCCCGAAGAGCTGAAACGAACGCAACAGGAACTGGCGAGCGTCGTCG |
| GCCTCCACCGGAAAGTGGACGACAGTGACCTTGACAAGCTCCCCTACCTCAAGTGT |
| GCCGTGAAGGAGATGCTCCGTCTCCACCCTCCCCTCCCCCTCCTCCAACACCAGGCT |
| ACTCAGGACTGCGAGCTCGCCGGGTACTTCATCCCCGTCGGGACAAGGGTGTTCGTC |
| AACGCGTGGGGCATCGGCCGGGACCGGGACGCGTGGAAGAGCCCCAACGCGTTCCG |
| GCCGTCACGGTTCGCCCTGGGAGGCGACGCCGCGGCGTTCGACTTCCGAGGGAGCT |
| GCTTCGAGCTTCTGCCGTTCGGGTCGGGGCGGCGGTCCTGCCCGGGCATGCAGCTGG |
| GGCTCTACGTGCTGGAGCTGGCGGTGGCACAGCTGCTGCATTGCTTCGACTGGAGCC |
| TGCCTGCCGGAACGAAGCCCGGTGACTTGGACATGGGCGATGTGTTTGGGCTCACTG |
| CGCCCAAAGCAGTAAGGCTGATGGCTGTCCCAACTCCGCGCCTCACTTGCCCGCTCC |
| TATAAGAAGCTTGCTTCTCTCCCGCGCGGCACTCTCGTTATAATTGAGATATTGTTCC |
| TCGTTAATTGGCCTATGAACATGCAGCTGAAACATCTCAATTGTGCCTTTGTTATGCA |
| ACTATTAAGCTTTTACTCCTTGATATATAAATCCAACCGCTTACAATAACGAAACAT |
| TTGCCAGAGAACAACATGAGGAGCAAGTGCAGAACCTGTATATTCCCATGTTTGCAC |
| CGAACTTACCATAAGAGTTGTTGAAATCACAAAAGATTAATGACCCTGGCGCAAAC |
| TCTATATTAACACAAAAGATCTGGTACATGCATGCCACCAGTATGAAGATGACAAG |
| ATTTCCGGGGAGTCAAGTCTGGGCCAATGGGCATAATTGGTTAATTTGTTTTGCAGC |
| AGACCAGAGTCTTGGATGTTGTTGGTCATCTTTAAACATAATCAAATTCGCATCGGT |
| TCCCAGTATCCCTGGCTGATCAACGTTGCTTTTTCAACATCAAACAGTGATATCTTC |
| CTCGTCCCCTGTCCAGGTGTAGCGATTGTCTTCCCACCTACAAAACAAGGTCTATAT |
| ATACGGTAACAAGTTCCAGTGTTGGATTCTACATGACCTTGAAGTTGGCTGTGAACT |
| GGTCCAGCAGCGTTTCTGATGTCGTAGAGATGCAATATCGGGTCACTACCGGCTGAT |
| AGGATCAGGAAATTGTTCCATTTGTTCCATTCAACCGTGTTGACACCAGTAGAGTGC |
| AGTGATTTGATGGTAAGAGCACAAGGCTCCGGCGACCTTGGATCGAGGACACATAT |
| ACGTCCATCGACTCCACAGTCGGCAAGTCGTTCTTTTCCATCCCTGCAAAAATATTC |
| AGGAACAACATATCGGTACTCTGAAGCACTGAAAAATACATGGCAATTCATTTTCGT |
| AAAGCAAATCATTGTGTTGAAAATTATAATGCTCTAGAGTTGAAAATATTGTTATGA |
| TATTCTATTTAGATTATTCCGACTCTCAATTTAAAGTTTGTTTGCAGCTACACTCAAT |
| GCATAGTTAAATTCAGAAATACATGTGCACAAGATGGGTCAACAGAACATTGCTTCT |
| ATATTTGCATGTTCTATAAACCATTCCTCCGTAAATTTCGCCAGTCACTAGCAGCAA |
| ACTTCATCCTCAAGAAAGTTCCAGTCATTAAAAGATGACCAGTTTGGTATATAAGTC |
| GGCGACGTTATGAACCAAGAGGTCGTTGTCTTCTATTGACAAGTCACTTGGTATGTC |
| CTTGTAGAACTACACAAGAACCTTGATGCTATTGAGTGAATTCCAAGTTCATGAACA |

| SEQUENCES |
|---|
| ATAGCAAGATTACAACAGTTGAGCTGGAAACTCATCAGCTACCGGCTTTCAGAAAT<br>GTCATGTAGAATACGCTACAACCCACCTTGACTGCTACACACATTATTCATCCATTG<br>CTTATTCCGTTATCCCCTTCTATGCAATTAAGGAGTGAATTTGAAGATGAGTGTCATT<br>GACTCAGAAAGAAAAGACAAGAAAATTTAAGAGTCGGTCTTCGAAAATAACAGTGC<br>TACAACATAAGATAGTATCCTCTACATTTGAATTTGTGAGAGCATCCTCTTTTTGTAA<br>TGCAAGTTTTGGGTTTCGGGAGCCGCCTCATAGATCATAACAAGTTGATAACTAGTT<br>TATTTTTCTTTAATGAACCGATTGAGTTGATGATATGCGATACTTATGATAAACACAT<br>TATCGATCTATATTTTCTACCACAAATTGTAAATAAAGAATCAGGATTTCAAGAGTT<br>CACTTTCATACTATCAGGAAAAAAAAACTAATTCTAAGATTTAAATATCTAAATCAT<br>GAATTAAGACCGGAAATCTCCTTCAGAGAAGGTGGCATGGAAACCAATTCACCAAC<br>GAAAACCAGACATATCTTAAATTGAAGAATGATGACTATTGTGCATCAAAGAGTTA<br>AGTAATAGAAGGGTTACCCAAAACAAACGCCCCTGATGACTCCTGAATGGTGGCCG<br>GTAATGTTCCGCTCTGCCACCAGCTCCCCTGCCGGCGTCAGCCTCGAAACACCAACA<br>GAGGAGTCCTTTGATGCCGTGG<br><br>SEQ ID No: 93<br>>Wheat_A0A077RPS5<br>CCTGGTTGTGTGGGGGTCACACTGCCTCATAACCAAGCAACCAGTGGTTG<br>CTTCTCAGAAATGGATTATTTTATCGATGTGTAGAGTTGATAGAATGGTATAAGATC<br>CGTCCACTACATCAACACATTGAAAGTACATAGAGGATGCACACAACCATTATACTC<br>ACAAAGCTAAATTGAGACAAGAAAGGGCCATGAAGGAAAAGGACAAACCATTGAC<br>CTCATGGTTACAACCACCCACCCATGTTCATGTCATGTCTAAACTATTCGATCCACA<br>ACCAAAGAAAGATGAAATGCAAGTCGAGCTGATGAAAATGTCCGCACTCAAAACCT<br>TTACTCATCACCAATGAAGACATGAACGTCTAAAACTCGGAAATGATTACTCCAAGG<br>CCATAGCCTGAACCAGAGATGGAACCCGGTACCGAGATAATACCCGAAAGCACGGG<br>GTGGTGTGGGGGGGNNNNNNNNNNNNNNGGGGGGGGGGGGAGGGGGGTTCG<br>CACCTCCATTTTTCTGTTGGTATGGGTTTCGTGGGAAGAATAAATGAACTTTACAATC<br>CACTCAATGAAACCTCTTTTAAAGATTTCTTTCACGCAGAATAAGGCAAAAACCATA<br>AGAAGTTTAAATATCAACCTAATCTTACCTGTGTTTTATTGTTAATTTTTTTTGAACA<br>GTTTTAATGTTAATTTGAGTATGTATTTTTTTATTCATAAGTTTTCCTTTAATATAAAT<br>CAAACAAACAATTCTGCAGAACTCACTATGTCCACAATTTTGTTGCCCATACAATCC<br>TATCCGTGTTTTAAAAATTCCGCAAATTATAGAGGCCCTTTAAAGGGGTATGTGCGA<br>CAATTCCCTGCTGCCACCGAATGCTAGAATGATCCAGAGAATCCCAGCAAACACAG<br>TAGATGCCACAAACACCACCATCCCCTACAACGTCACCCCATGAGGTTGTTGAGATC<br>TGATTTCCGCGTGCAGCCGTGGCATCAATCCAATGGCACAGAGCCCCGTTGAAACCT<br>AAGTTTAATGTCCACATGTTCACGTGCTATAAAACAATTAACATACACTGCTTGTGA<br>CAGCTTACTAATTGAAAGGTGCTTAGCTAGAAATCCTCAATACACTGCTTGCGTTAT<br>AGCTTACTAATTTAAGTCGCTTAGCTTGAAATCCCCAATTATTGGGAGCACTACACA<br>AGCTATATATGCTGACTGGACATATATATACCCTCCCCCGTACCACCAACTCCATTT<br>AAAAAAAAATGCTAACAACTCCACCCAAGAAACTAAAAAAAACTTAAAAGAACCCT<br>CAACTACTCATCTAAGGCATCAAAGAATATATCATGCACACCTTCTTTTATGAATTA<br>TAAATTGCATTATTATTTGTTTTAAAAAGTCATAGATTTAGATGTTTTAACATATCT<br>CACTTAGGTTATTTTTATGAAATCAACAAAAGCATCTGTTGATTATTCTTGGTCCAGG<br>CTCATGTGAGGGTAAGGCTCCCAAGCACGGAAATAGCCAATTTAAGGTTCTTAAGGT<br>TTATCAAGAAAAATATTTTTCAATAGGTACTTTGCGTAAATACAGCAGGAGAATA<br>CTACTTTATGTTGGATCTAGTGATATTGATTTGATAGCGTGCATGTTGATATTTTTCT<br>TGATAACCAGAGTCAAACTTAAAAATCAAGTAAGCCTTGTATAAATCCATCTGGAG<br>GGAGTATTAATTATTTGATGCAAAAACAGAAACACTAGTGATAGTTCACGTGTGATG<br>CGCAGGGCGTGCAAGTGGAATAAAAGAAAACACCTCACCCACAAGAAAAAAGAAA<br>AGAAATCCTTTTCTAAAAAAATAAAAAAGAAAAGGAAATAGTCGGCCTCGTGTGCA<br>ATTGCTATCATGCGGTGTGACGCTACTGTTTTTCAACTACAGTAGCACAGTATATAT<br>AAAGGCCCCATGCATCCACAGGGATTACAGCGGAGTTTCTTGTTTGAAGCTAGTGCT<br>CGATCGTTCTTATTGCCAATGGCGACCTTTGCAAAGATCGCCATGGAGCTCCTCGCG<br>GATCCACTGATGTGGCTGTTCCTCGCCTCGCTGGCCTTGGTAGCCATGCAGAGGCGG<br>CGGCTGGGCAGCGCGCCGTTTCCTCCGGGCCCCAAGCCGCTGCCGGTCATCGGCAAC<br>ATGACGCTGGTGGACCAGCTGACCCACCGCGGGCCTGGCTGCGTTAGCGAAACAGTT<br>CGGCGGGCTGCTGCACCTTCGCTTCGGCTGGCTCCACGTCTTGGCGGTGTCGACGCC<br>CGAGTACGCGCGCGAGGTGCTGCACGCGCAGGACGGCGTCTTCTCGAACCGCCCGG<br>CGACCATCGCCGTGGTCTACCTCACCTACGGCCGCTCCGACATGGCGTTCGCGCACA<br>ATGGCGCCTACTGGCGGCAGATGCGCAAGCTCTGCGTCACAAAGATCTTCAGCCGC<br>CGCCGCGCGGAGACGTGGCTCGCCGTGCGCGAAGGGTACGGGGCGCTAGCCCGCGA<br>AGTCGGCCGGCGCAGCGGCGAGGCCGTCAACCTCGGCGAGCTCATCTTCAACCTCA<br>CCGTCAGTGTCATCTTCCGCGCCGCCTTCAGCACCTGCGACGAGGACGGGCTCATCG<br>AGTTCATCGCCATCCTCCAGGAGTTCTCCAGGCTCCTAGGATTGTTCCACATCGGTG<br>ACTTCTTCCCGTGGCTCGCCTGGGTGGGCCGTCGTGGCTTCAACCGCGGCTTAGCA<br>CGGCGCGCGGCGCTCTCGACAGGTTTATCGACAAGATCGTCGACGAGCACATGAGG<br>AGGGGCAAGGACCCGGCAGACCCCGACGCCGACTGGTAGATGGCCTGCTCGGCTT<br>CCTCGCTGACGCAAACCCAGTCAGCGGCAAGCGCAGAGAGGACGCTCTCCGCTTCA<br>CGCGGGATAACGTCAAAGCTATGATCATGGTACGCGAGTAATTTGCTGTACTGGTAT<br>ACTCTCCCTGTTCACACATCTCAAGAACTTCACTTGGTACATTTTTTTATTACTGTGT<br>ACTACTAATACATTTTTTTTGCGAGGGAGTACTACTAATACTAATGAACTAAAAGC<br>ATGGCAAGTATTTTGGAACCAAGGGAGTACAATTTTTTTAAGATAGCTAACGTCTAT<br>CCATCATATGAAATGTTAAAAAGAAATTCCACACCCACAAAAAAAATCCACACATA<br>TTAAAAAAGTTCCATTTGTTCAGTTTATCATTCTACTGGTATATGACTTCCTGAAAG<br>AGAAGGAATATTATTTCCTACAATATATTGTGGTGACGTGGCTATCTTCATACGGCA<br>TATAGGACATGTTATTTGGTGACCGGAGACGGTGGGGTCCACCACCGAGTGGGCG<br>ATGGCAGAGATGATGCGTAGCCCAGATGAGCTCGAGCGGCTGCAGCAGGAGCTCGC |

| SEQUENCES |
|---|
| CGATGTGGTGGGGCTCGACCGGGCTGTTGAAGAATCCGACCTCGACAAGCTCCCTTT |
| CCTTAGGTGCGTCGTCAAGGAGGCGCTTCGCATGCACCCGCCCATCCCGGTGCTCCT |
| CCACGAGGCCGCCAAGGATTGTGTTGTTGGCGGCTACTCCATACCGAGAGGCTCCCG |
| CGTGTTGGTCATTGCTTGGGCGATCAACCGCGACTGCGGGGCCTGGAAGGATGGCG |
| ACACATTTCGACCAGCACGGTTTATACCCGGCGAGGGGGAGGCCGCGGGCTAGAC |
| CTCAAGGGAAGCTGCTACGAGTTCTTGCCGTTTGGGTCTGGCAGGCGCTCATGCCCT |
| GCGCAGGGGCTCGGCCAACATGCGGTTGAGTTCGCAGTCGCGCAGCTGGCGCATGG |
| TTTCAATTGGAAGCTGCCTGACGGCATGAAGCCAGCAGAGCTTGACATGGGCGACA |
| TTTTTGGCCTCACCGCGTCACGCTCCACGCGGCTCTACGCCGTGCCCACGCCCCGGC |
| TCACCTGCCCCGTGTAATGTGATAATTATTGGACAAGGCGTGCAGTGCCCACAGAGA |
| CGTAATATCATATTGCCAATAATGCTACACCTACAAACAACCTATAAATGTTTACTT |
| AACATTTCAAACTATAATTCTCTGCCCCCTGAATTTAGCAAAGTTTGCCCCGTTATCA |
| CGTTTTTTGTATGTGACAAGCATAACATATCCGACTATTGTCATTGTGAACCATCATC |
| GGAGCTTGAGAGAGAGAGAGAGAGAGAGAGAGAGAGAGAGAGAGAGAGAGAGAGAG |
| AGAGAGAGAGAGAGNNNNNNNNNGAGAGAGAGAGAGAGAGAGAGAGAGAGAGAGA |
| GAGAGAATCATATTTGGTCTTACAATAAATGCTGGTCTTCTTGTTTATTATTTTGCAA |
| TGTTTGACTTCGGCTAAAAGATATAATCTTTACGTATCAAGACAAAATATACCATTC |
| ATTAGTGTAGATATGCCTTTCTCATTTAGCATGTAAGTGGCATTGCGCACAAGTATA |
| AGAGCTGGCTAAAGTTGGGAATGTGATATGGAGGAGTTCAAGTCATACCGGAACCT |
| AAAATCTCCTCGACATAGATTCTCAAAGAAAAATCTTCTCCACAGACAAAATTAACA |
| TGTGAGCGAGCTATAAACCTGCTATTGTATTTACTCTGATACGCTGATGACTTCGACT |
| TGGGGAGCATGACCGCGACCACCACACAATGCCCAAGACAAAACTGGTCGATTAGC |
| CAACTGGGCGTCCACATCTCCTAGGCGTGCCACATGAGCGAGCTCGTCAGGTATATA |
| TACATATACCATACCACACTGTCATTTTGGAGCATCCCCCACCACCCACTGGTCCAG |
| TAAATCCAGCCAGTTAAGCCTCCTCTTCCTCCTCCTCCTCCTCCTCCTCCTCAGTGCA |
| CTGAGTGCTGGTCCAGAAAAAGAAAATGTGCTTCGAGTTCAGCTTGTGCTTCGGCGG |
| CTTTAGAGATGACTACAACGGCGATCGGTCCAACCACAACAAGTCCGGGGACTGTC |
| AGCGACGCCGTAGAGGGAACAACAATAGGAACGACTACCATGCATGTAGTAATTTT |
| TTTCACGAATACATGTAGAGCGTATCAACGCATGTGCATGGCTGTCGTTAGCTCGTG |
| TTGTAAGGTGTTGGGTTAAGTCTCGCAACGAACACATCCCTCGTGTCTAGTTGCCAC |
| TGTAAGTTTGGAACCCTGAACAGACCGCTGGTGTTAAGCCGGAGGAAGGAGAGAAT |
| GAGGCCAAGTCATCATGCCCCTTATGCCATGGGCGACACACGTGCTATAATGGGCG |
| GGACAAAGGGTCGCGATCTCGCGATTGTGAGCTAACTCCAAAAACCCGTCCTCGGTT |
| CGGATTGCAGGCTGCAACTCGCCTGCATGAAGCAGGAATCGCTAGTAATTGCCGGTC |
| GGCCATACGGCGATGAATCCGTTCCCGGGCCTTGTACACGCCGCCCGTCACACTATA |
| TGAGCTGGTCATGTTTGAAGCCATTACCCTTAACTGTAGGGAAGGGATGCCTAGTTT |
| GCTTCCTTCTATTAATGCATTGATATGCTCTGCGTATTCGCAAAAAAAAAAAAACTAA |
| AAAAAAACTACTATGCCGACGGCGATAGAAGGCATCCTACCACAACAAACAGCCCA |
| CCGCCGTAGACGAGGCCGGGCACAAGGCCTATCATGACGGCGCTACTGGCCACCCG |
| GCCGTTTCGCCGCCTTCAAGACACCAAAGCTTCCCAGCGTTCCCGGGCCGCACAACA |
| CGGCGCACCTCCAAGAACCAGCTCCAACACTGCCCAACTGCCACTACCACGACCGC |
| TCTTGGCAGGTAGTCCAGATTAGCTATGCGGCTATACACCACTGTAAGTAGGATTCG |
| CTAGCATGGGCATGGCAGTCCAGTTCATCAATCGCTCCCTCTCCCTAAATACTGCAT |
| ATGCTTCTGTTCTATCCGTAGCTCTGTTTTTCTCCTCTGTTTTTTCTCTCTTTTCGAATT |
| TTGATCAAGTGGAAGTGCAGTGATGTATG |
| |
| SEQ ID No: 94 |
| >Wheat_W5A2I1 |
| CGGGATAGGTGGCCCCACCCGGTGGACCCGCGGGACCCTTCTGGTGGTCT |
| CGGTACAATACCGATGACCCCCGAAACTTTCTCGGTGGCCGAAACTGGACTTCCTAT |
| ATATAAATATTTACCTCCGGACCACTCCGGAACTCCTCGTGACATCCGGGATCTCAT |
| CCGGGACTCCGAAGAACATTCGGGTTACCGCATACTATTATCTCTACAACCCTAGCG |
| TCACCGAACCTTAAGTGTGTAGACCCTATGGTTTCGGGAACCATGCAGACATGACCG |
| AGACGACTCTCCGGCCAATAACCAACAACGGGATCTGGATACCCATGTTGGCTCCC |
| ACATGTTCCACGATGATCTCANNNNNNNNNNNNNNNNNNNNNNNNNNNNNNNNNN |
| NNNNNNNNNNNNNNNNNNNNNNNNNNNNNNNNNNNNNNNNNNNNNNNNNNNNNNN |
| NNNNNNNNNNNNACTAGTGCACCTATACAATTTACCATTGTATTGGGTGTGTTGGG |
| GACACAAGAGACTCTTTGTTATTTGGCCGCAGGGTTGTTTGAGAGAGACCATCTTCA |
| TCCTACGCCTCCCACGGATTGATAAACCTTGGGTCATCCACTTGAGGGAAATTTTCT |
| ATTGTCATAAAAAAACTCTATGCTTGGAGGCCCAACACGAGTCTACAAGAAGAAGG |
| TTGTGTAGTAGACATCAGGAGGCGCGATGATAGAACGTCTCTACTGTGTCTGAGCCA |
| CCCCGACGATGAGTGCTTGACCGTCGCGCGTCAACATCATCCTCGGACCGACTATGA |
| TTTGCATGCATGTAGCCTATGCGGCACCTGTGGTGGCTACAATGAGGCCGAGACACG |
| CCATGCCTGTCGCGAGAAGGCGAAGGCGGTGTTAGTGACGTCCCGATCCAACGACA |
| ATCCGGTCATCCGCGTCGTCCAGCAGCGGGCCCTCACCTCCAAGGAATCAAATGCGC |
| GCTGCCGCCGTCAAGTCAACACCAAGGTCCTCGCGGATGGCATCAATGATTTGGTCC |
| GCGCCACCGAGAAGGTCGCGCATGATGCTCAGCTCACCTATGTCGTCCCAGGCCACC |
| CCCGAACTCCGGCAACCCCACGCAGGGCACCTCCACAGATTCCTCGTCCTCCGACTA |
| TGAGATCTGTGGCGTTCCAGCCATCCCTACATTTTCTTTAGCCGCTACTACCGTGACA |
| AAGACGACAAGGGCAAGGGCAGTCGTCGGTGTGAAACTTTCATTGTCCTAGTCTAGT |
| TTATTGTTGTGTTTTGTTGTCATGTGTTCCAGTGTTGAACAATGTCCTATGTTAAACTT |
| TGTTCCTATGTGCATGCTATGTACATATATGATGATCGAGGTTGCATTTATTTGTATG |
| AATTTGAGGATTGAAAAATGAGGGATTCGACTACCCGAACAAATGAAGGTTGAGTC |
| CATGCTACCGGGACACGTCTGGACAAATGAGGCGCCAAGATAGCCCGTCCCATTG |
| TGGTTGAAGATGATCTTACAATCCGTAACTTCTCTCCTTATGTTTAGCAATTTTGAAA |
| AAGTTTACACTTTTGATTATCGAAAGTCCTACATCCACGGGCTCTTATGAAGCCCCT |
| ACATAAACTTCCTTATTAACTCTATCTCCCCCCCCCCCNNNNNNNNNNNNNCACCCT |

-continued

| SEQUENCES |
|---|
| AATTTAACGAGGGTGGGCCCTAGCCCCTGATCCGGGTCCAATTAATTACTTTCACGT |
| CAATTTTTATGTAAAATTCTCACGTAAATTTTTGTAGGTGTAACATTATTCTTTGACT |
| ATTCACTTGTGAGACCTAGGGGGAGGGGCTCGAAAGTTGAACAAATATATAGTATC |
| AAGTGACATAGGATTAAAAACTAAAAGAAAAAACTAAAAAAATATTACGCCAGTCT |
| CCATGCAAGATCTCACGAATATAATATCGACTAAGACATAACAAAGTCTTAGTCGAC |
| TGAAATTTAGCAACACTGATGAATATATAAACCATGCATCCACACGGATAGCTGTGG |
| AGGGCTCTTGCAGTATTACTATTATCGCTATCCAGCTCGTGAGTCGTGGCTATCGTCA |
| ATGGCGGCCTATGCAAAGGTCGGCACGGAGTTTCTCAAGGATCCACTGATCTGGTTG |
| TTCCTCGCCTCGCTGGCTTTCGTCATTCTGCAGAGGCGGCGGCTGGGCAGCGCGCCA |
| TTTCCTCCGGGCCCGAAGCCGCTGCCGGTCATCGGCAACATGGCGTTGGTGGACCAG |
| CTGACACACCGCGGCCTAGCGGCGCTAGCGAAGCAGTACGGCGGGCTGCTGCACCT |
| TCGCCTCGGCAGGCTCCACGTCTACGCGGTGTCGACGCCGGAGTACGCGCGCGAGG |
| TGCTGCACGTGCAGGACGCCGCCCTCTCGAACCGCCCGGCCACCATCGCCGTCGTCT |
| ACCTCACCTACGGCCGCTCCGACATGGCGTTCGCGCACAACGGCGCCTACTGGCGGC |
| AGATGCGCAAGCTCTGCGTCACCAAGATCTTCAGCCGACGCCGCGCCGAGACGTGG |
| CTCGCTGTGCGCGAGGGGTACGGGGCGCTGGCCTGCGCCGTTAGCAGGCGCTGTGG |
| CGAGGCCGTCAACCTCGGCGAGCTCATCTTCAACCTCACCGTCAGTGTCATCTTCCG |
| CGCCGCCTTCAGCACCCGCGACGAGGATGGGCTGGATGAGTTCATCGCCATTCTCCA |
| GGAGTTCTCAAGCCTCCTAGGATTGTTCCACATCGGTGACTTCTTCCCGTGGCTCGGC |
| TGGGTGGGCCGGCGGGGCTTCAACCGCCGCCTCCGCACGGCGCGCGGCGCTCTCGA |
| CAAGTTTATCGACAGGATCATCGACGAGCACATGAAGAGGGGAAAGAACGCCGCCG |
| ACCCCGAAGCTGACTTGGTAGACGGCCTGCTCGCGTTTCTCGCCGAGGCAAACCCAA |
| TCAGCGGGAAGCACAGAGAGGACGCCCTCCGCTTCACCCGCGATAACGCCAAGGCC |
| ATGATTATGGTACGTAACTGGTACTGTATTTACCATCTTACAGTCTTTACTCTTTACT |
| GTATATCCATGGCGGTGTGCTCCTGCTCCACACTAGTTCTACTGACGGACGGCTTGA |
| TCTGCAGAGTAGTATGACCAATATCCTACGACAGAAACCTCGTACATGTAGGCTAGC |
| ACCTCTCTTTCTTTTTGACGTGTTTGCTATTTGTAATTGTAAGTTGCTTGATAATGACA |
| AAAACGAGATCGGTCGATTTTCCTTAATGAAGAAAGGCGAGGCGGCGCCGAGCTCC |
| AAGGCGGAGAGGGGGGCGACGAGGCCAGTGTCCTGAGTAAGAGTAAGAGCATCTA |
| CAGCCGTACGCCTCAAATCATCCCACATAAGCCCGCGGACACGCCCGGCCAGTGAC |
| CGGAAGGGAGAGAGAAGAAAAAACGTGACCCAATCGGATCCCTCGTACCATCCCTA |
| TATGCCCGGGCTGTCCGCGAACCCTCATATCCATCTCAAATATGGGGAGGATATGAG |
| GGCTCGCGGACGCGCCCGAGCGCGTTCGGGCATTCTGCCACGTAGGACTCGGCCCC |
| ACACCAGACCACCTTTTTTTCTTTATTCATTCTTTTATTTCTCTCTCTTCATCTCCACC |
| GATCACGTGCAAGTGACCGGAGAAGAAAAATAAGGAGTGTGGCTGCGCGGACGAA |
| TAAATGGGGGCTCAAAACGGACACGCCCGGCCACTGGCCGGACATGTCCACGGGTG |
| TTTAAGGGGTCATATTTGCTATGTCCAGCTGTAGATACTCTCAGAAAAAGCCATTAA |
| CTAGCGGGAGACGGGGATGCAGCGAGTGGGAGCCTTGACGGTTGGTGGTGTGGAGT |
| TGGCACCCGGGATCAGAGAAGAAGGGTGGTGGAGGGTTAGAGGGGTAGCAGGGGT |
| GGCTTGGGCACGGAGGCGAGGCGCGTGAGGCAGTGGCGCCAGCTGTAGGTGACGAG |
| GGCTGATGGTCTGGCGGATGTCAGACGGGCGGCTCGGCGCAAGGAGGAAGGGAAG |
| GGAGTGCTAAAAAATGCACGATCCCTTTTTTCAACTCACTGGTCCTTTTCTTTCTATC |
| CTCGTTATTTTTAGTTTCTTTTTTTACTTTTGTATTTCGGTCAATTGACTTTCTACTACG |
| TGGTTTTGATACCTAATTATTATCTATTATTTAGGTAATATACTCTGGCTTGGATGGT |
| GGTTTTTTGCTTGTTGCTGATTTCTTGTTTTATTATAATTATTTTTCCCTCTTATTGTTTT |
| TGTTTTTATTTTTGGTTTGTTGCTAGTTTCATCAAGTGCATATACGTATTTAGATGTCC |
| TTTTGTGTCTTTTCTTCACAAAAAGTGTATATACGTATTTTAGTGTTTTTTACATTTC |
| AAAGTAACGGAGTCGCAGTAGACATGTACCTTTGATCTTTAGAGTATAAGTATTAAT |
| AGTATTACGACAAATACAAATACACTTGTTCACTGAATGGTTTATGGTGAAAGGTGA |
| GATTCATGTAGGTTGTATTTTCATTGTGTTTTTGGCGCAAGATCTTTGTCTAGAATAA |
| GTAACCGTGCATTACAATTGTTTTCACATGCTATGAAACATGAAAAACATAGCAAGC |
| AATGCTGTAACTGAGGTTTGAAATCACATAAATTTGGTTTTTATTTGATAGAGACGT |
| GTGTCATTGTTTGTATGGTGCATTTTTTTATTTATACTGAGTTGGAAATCGGTCAACA |
| TGATAGTGCCATTCGTCGCTGTTTGTATGGTGCAAAATTTTGATTTGTTTTTTGTAGC |
| AAAAATGTTGTACGGAACCATGGTTCAGCCGAAGCTACGCTCGACACCATTGATTTT |
| TAGGCACTATTCATAAGGATCCATGCATGGTTGATTAAAAAATACAGCTGACATGCA |
| TGTCTACTCATGAGGATCCATGCATGGTTGATTAAAAAATGCAGTTGACATGCATGT |
| CACAGATCCACATGTAGTAGGATGTTAAATCGTATGACATAGACCCATAGGTTCGATT |
| GAACCATGGTCCTGAATCATGTCTCTTTTTGTAGCTTGTCCTTCGTGGTACCTGCT |
| ATCGTAGCCATTCATATATGCTCAGTTCCATGTGGATGTGTGCATCGATGGAAAATT |
| AGCAACTGGCGTTAGCTCTCAAATCTTAATCTCCTGCCGCTAGGACTAGTAGGGNNN |
| NNNNNNNNNNNNNNNNNNNNNNNNNNNNNNNCCCCCCCCACCCACAGACTGAGACG |
| TAGTGCAGACCTCTCTCTTTTTGCATGCAGCGCATCTTTCTCTCATAAACTTTACA |
| TGCAACTCTCTCTTTTTTTCTCTCTTTCGGTAAAGTCTGCTCTTTAAAAATGTCAAATA |
| AAAATCCTAAAAATCACTTCCTTGAAAAAGAAATCACTATTACTCAATGCACATGGG |
| ACAGAGGGGTGGAGATAAAAGATTCTCCATGCAAACCCCTCTCTTTCTCCCGGTTGG |
| ACAAAGATTCCTTCATGGACCCGTTCTCTTCTCTCGCCTAGCACATTTAGTGAGATGG |
| AGCTAGGAAGGAACTTTGCGAATTTTGATTGGTACCAATTGAAAACCAATTTAATGG |
| TAAAAAATAGTCACTCTCTACATAAGTATGTATAATCAAAGGCTAATATAGGTTAAT |
| ATGCACAACTCCTTGCCACTGAAGACATGAATAATTTTGTAATGGAAATAAAATTCT |
| TCAAGGTGCCCTTTAGAATAAAGGAACCGTGGAGAATAAGAAAGTGAGGCTTGCAA |
| TCATAGGATACACAAATATGGGATTTGTACATTTTTTATTATTAGATTGCATTAAAG |
| AAAATTTATGTATGACTTGAACTTTTGCTACAAATTTGGGAGGAAATTAAGTCTGAG |
| TTCCAGTCTCGTGTCAAACTTCTTTAGAAAGTTCAAATGTGTCTTCTTTGTTTTTGTCT |
| CTTAAATATAACACCTAATCTCAAAGTCCATGTATCTTGTGCATTTTTTGAAAAGATG |
| TATCTTTTGTGCGCGCATCTAAATATGTCTTCTCAACAACTCGTATTTCTCAGATGAA |
| AAAATAGCCAAGTAAATCATTGTGTGTTTTTTTGTTCTTACCTTGTCAGATTCATGTG |

SEQUENCES

```
TTTAAGGGAAAGAACCCAAAACATTAACAATAGTTAAAATAACTTATCGAGTATGTT
AAATCCAAACGCGGTTTTGGGTGGGAGAGAGAGAGAGACTACCTACCATCAACATC
ACCGAATTCCTTTAGCAATAAAGAATTATTCCTATATATAGTACTCCCTCTGTTTTAA
AATATAGTGCGTCCGCGCTTTCTGATGTTCAACTTTAATCATAAATTTAATCAATGAG
ACCGACTATGGCGGGAGCAAAAAATATATACTCCCTCCGTCCGAAAAAGCTTGTCC
CAAGCTTATCTCTCAAATGGATGTATCTAGCACTAATTTGATGCTAGATACATCCATT
TGAGGGACAAGTTTTTTCGGACGGAGGGAGTAATTGAAAATTTCTTTTGAATACGAA
TTCATTGGTATAACTTTTGCTCCCAACACAGTTGGTCTCGTTGGTTAAATTTATAATC
AAAGTTGAAGCACAGGAACCGAGGACGCACTATATTTTGGAACGGAGAAAGTATGT
GGTAACTTGCATGTGGCTATCTACACAGGACATGTTGTTTGGTGGGCCAGAGACAGT
GGGGTCCATGACCGAGTGGGCGATGGCGGAGATGATGCGTAGCCCAGACGACCTAC
GGCGACTGCAGCGGGAGCTCGCCAATGTGGTGGGGCTCCACCGTACCGTGGATGAG
ACCGACCTCGACAAGCTCCCTTTCCTCAGATGCGTCGTCAAGGAGGCGCTCCGCATG
CACCCACCCATCCCACTACTCCTCCACGAGGCTGCTAAAGATTGCTTTGTCGGTGGC
TACTCTGTGCCCAAAGGCTCCCGCGTGTTGGTGAATGCTTGGGCGATCAACCGTGAC
CCCGGGCCTGGAAGGACGGCGACACGTTCCGACCTTCGCGGTTCATGCCCGGCGA
GGGAGAGGCCGCCGAGCTGGACCTCAACGGCGGCTGCTACGAGTTCTTGCCGTTTG
GGTCCGGCCGGCGCTCGTGCCCTGCGCAGGGGCTTGGCCAACATGCGGTGGAGTTC
GCTGTCGCGCAGCTCGCGCACGGATTCAACTGGGAGCTGCCCGATGGCATGAAGCC
CGCGGAGCTTGACATGGGCGACATCTTTGGCCTCACCGCATTACGTGCCACGCGGCT
CTACGCCGTGCCCACACCACGCCTCACTTGCCCCATGTAAGTATCGCACCAGACTTG
CTCATGGAGTGCCTTGTAACCGTTGGTCCGTTCATTGTGTACCCCGACCGGCTTGGTT
TGTTTTGGACTTGATCTCCGAGTCCTAATTCGCAAGAAGAGACTTCCTATCAATAAA
GATCATGGTCATAGATGTGCGTTCATGAGCTATCTCAATATTCAAATTGCTCATGAT
ATTCGCGGGGCGTGCGTGTGCGTGTGCGTGTGCGTGTGTGTGTGAGAGAGAGA
GAGAGAGAGAGATTTTACATCATATCAAAAGGATGTGCTTTTCAGAACCATATTGGT
ATATTATAGTTGTTGATATTCTGATCTATGATATGGAATTTTATAATGTTTGAATTAT
AATAGAAAAAAAACATGCTTTATGTTTAGAAACCGGCGAGTGCCATTTAGGGCCAG
TTATTTTGGAATAATACCATTTTTTGGGTAAAAAACAAATTACCGAATTCCTCCCCA
ATCCTAGCCCAATAGACTCCGCACCATGCCCATCCTAAGATTCGCTACGCTCCGTGA
TCATTACTCCTTCCAACTCCAAATGAAGTCTTATAAGTTTTGTCTAAAGTCAAATGG
TGCAAAGTTTGATCGATTTTTTAACATAAGTTATAGGTGTTCTTTTTGGAGCCGAAAG
GAGTTCACCACAACCCATTATGCTCTTGAGCATACTCTCTTCCCCCTAGGTTCTTAAA
TAGTTTACATGCATCTACTTGTATAGGCCTAAGTCCGTAAAAAAAGTACTTGTATGC
AACTCCAATGATGTACATCAAAATGAACACCTCAAATGTCCGCGGTCAGCGGAGTT
GGTCCTTCAACCGTATGCATCAAATCGGACAGCGGAGTGAGCCAGACGAACCTAA
AGGACAAAATACATGAGTTGGGAAGGACATGTGGTCCAACTGATAGTGGTTCAAAT
GGATTATCCGAACTCTCCTAAAGCTCCCTCAGGTTTGGTTCAGGTTTGTAGGAATTC
AGATGTCCAACCTAGTCCGCAGACGTTTGCTGAACTGCATTGGAGGGCAAAAAGTG
TCTGTACCGCGTGGTTCAAACGTTCAAGGGTGATTTGGTGCACATCGTTTCCAAACT
AGGTTCAGAGCCAGCTCTTTTTAGTTTACTTTGCAACTTATGGTCAAAATAAGCTAA
AGCTAGACATAACTTGAAATTTCTCTCCAGCTTAATTTCTAAGCCCGTCCAAATAAT
AGTTGGTAGAAAAAAACTACAAGAGAAGTGCTTCTAGAGCTTCTCCGTTAGGGCTG
GAATTCGAGCCGAGTCGAGCCAGCTCGGCTCGACTTGCTAAAGCTCGTTTCGTTAAC
GAGCTAGCTCGACTCGACTCGTTACTATAACGAGCTCAAATCCAAGATTGGCTCGAC
TCATATAACTCGCGAGCTGGCTCGTTTAGCTTGTTAAGCTCGTTAAGGATATGAACA
TAAAACCTTACGAATATGAAAAAAAATATTACTTGAGAATGTATAATGTACATATTA
AATATGTACAATGTTCACAAAAAATTGTAAGCATGTATGAGCATCACTTACAATTGT
TAGTATCGTGCAGGCGCAGCGCCGACGCCGTCACAATTTATAGGATAAAGAAACAA
GGAAGACATGAGGGAAATCGACCGCCTATAACTTCGCTAGGAATAGAAATGGAATG
AGAGAAATCTTCGTGTGCGATGTGTGAGTCTTGTGGGCAGTTGGGCCTTGTGTTGTG
CGCCTGGGACACCGAGAGCTTGGCTGATCTTTTGTACCGAGCCTAAACGAGTTACAC
GAGTACTCGTGAGATCGTCTCGTTTAACTTGGTCTGTAAATGATCTTAAACTAGAGC
TCGGCTCGACTCGTTATTCTTCGAGTTCGAGTCGATTCGAGCCGAGTCATGAGCTAC
TCGTTTAGCTCGCGAGCTTCGAGCTTTTCTTCCAGCCCTATTCTCCGTAATTCAAACC
CTTCCATAAAAAAAGATAATGTTTCCCTCTTTTTAGGAAAAAAATGCTACCGCATA
ACTCTTCGTGCTGAATAGAAAACCACATGCGCAATTGCTTCCCCTTTGCTCCAACA
CCAACTACTACTACGCCTAACTCCACTTAATTAACCCCAAGGGACAATTGAAGTACT
TTCTAGTTTGATGTGGAAGTATTGAGTGTTCAAGCCCTAAGGAGCAAATGGATAAGC
CTCATATTCTATCAAGTTATATATGGTTGTGTGAATTTCTTTGGTACTCTACTCGTTTT
AATAAATGGTTGTCTA

SEQ ID No: 95
>Wheat_W5B6W3
TTAAATTATCCTTTACTAACGAACATATACGTGATAGCATTGAATGATGTC
TTTGAAATCAGAGTTTGCGGACGGGTCATTTGTCCGCGGACAGATGCCGATGGAAAT
TTTACGGGTCAGCCTTGGAGATGCTTTTATACTACTACTCCGATACACGGAAATCTC
AGGATTTGTTACATTATCGATTATTAATTTTTTTGCGAATGTCATTATCTGGAAGTT
GAACAATCTGTTGGAGGTTGACGGAAGAACGTGAAGAATCCACGCAGCTCGGGCGC
CGTGTATATGCGACGAAGACACACGAATTCCAATGACTTTGTTAATTTCAACATCAC
TGGTTCGCCTTGTCTGATACGTTCTCACAGGTCGGTTTGCTGTCACGGACCGGGGA
GTCTGAACGAGTCCTGTGTACGTGGTACAACCAGTAACTGTCTTCCGCCAACATTCA
AGGATTGGAGCGAAGCTAGAAACTACAAGAGGTTCCGTTGACTAACTCAGTGATCT
CCTGAAAAGATCACTAATAAGGTTTTACTGTCACCTTACAATTCTATCGAACCCATG
TATTTGTAACAGATTTTCTTTTTTTGCAAGGGATATTGTGACAGTTTCTTTACTGGT
AATCGACGGGGAAGCCCGTTGTTTTCCCTCCTCATTTTCTCATTGTGCTTTCGAAAT
CACGTGAATCAAATAAGATGCCTATGGGTATACTTTTCTTTTCTTTTCTTCAGATTTT
```

-continued

SEQUENCES

CTTATCGAGGTGCAGAATTGTAAGGTGACGGTAAAACCTTATTGTTATTTTCTCAGG
AGATTACTGAGTGATATTGATGGAAAAAAACAACAACATGCTCCTGTAGCCGGTCC
ACCGAAAGCACTTTTCACCCTTAATTTTGTTTCCCACCCTCAAGCAAACAGTGAGAT
TTAGAAAACTCGACTTTTTTATTTATTTGTGGAAAAAAGAGAGCATCCCGTACGGTT
TCAAGTAACTATATAATGTCTTTCTTACAAGGAAAATGATTGATACCAACCAGCTGA
AAAACAATTTGGCGCCGGTCGTCTCCTTCAGTTGCCACGCGTCCGCTTCGCTTACCG
CAACCTTATCTCTTTCTTCTTGCCTCTTCTTCCCCGCTGGCATGCACAACCTCCTCTTG
CTCCAACCGCGATTTGTGGCTCCCATCACCGGTCATCTTCCCTGATGTATGCTCCCTC
ACCCGGATTCGTGAGTCAGATTCACGGCCTCTATTGCCGGCCATCTCCCTCACCATG
AGCACCCGCCCCGCCAATGTTGCAGGTGTGTCACTTGCCGCCAGACCAAATCCACAA
GCTACATCCTCTCTCTCTCTCTCTCTCTCTCTCTCTCTCCACATGATTTTTCCTACC
GACGGATTTCTTCTTCTTCTAAAAAAGCCAAATATGCTTTTTCCAACAAGTGTCTTGT
TGCAATGACAATTATGTCATCGAGCAGGCGCGATGAGATTTTCTACAACAAGATATC
TGTTACAAAGGTTTCTACAACATGAATTCTGTTGTAAAGGATTCTGCAACATTAACT
GTGTTGCAACCGTGAAGGGCGCCGCTTGACCGCATCAGATCTGACAGCTCGCGACCT
GACCGATCTTTTCGGAATATCAATCTGCCGACGCATGGCACGCCCCTTCATACCTCT
CCTGCACTAGAAGGGGTAAAACAGAATAGTACACGCATATCATCCCAGTCCGGTGC
CAGGCCAACCTCTCTCGGAGGGAAGGCCTTATTCGTCTCGGAGGGGGCTAACAAA
GACCGGGGCAACGGTTGTTCCCATTACCATTTGAATTTTCTTGTGCCATGCATCCTCG
AGCCTACTCCTTTCCCTACTTCATTCCAGTTAGCAAATCTCACTATATAAATCCGGCT
CCTTCCACTTTCCTCCTCAGCTCACTCCACGAGCGTTATCAACATATAGGTTCCCCCA
CAATTGAATAACCCAACAAACAAAAAAGCTAGAGCTTCCAGCAGTTTGAGTATCC
GTCAATGGTGGGCTTGGCCAAGATCGCCATGGACTGGCTCCAAGAGCCACTGAGCT
GGCTCTTCGTAGCCTCGTTCGTCTTCGTGGTGCTGCAGCGGCATCGGCAGCGGCTGC
GTGGCAAGGCGCCACCGCTGCCTCCGGGGCCGTCTCCGCTGCCGATCGTCGGCAAC
ATGTTTATGATGGATCAGCTGACCCACCGGGGCCTGGCGGCTCTGGCTAGGCAGTAC
GGCGGCATTCTCCACCTCCGCCTCGGCCAGGTCCACGCCGTCGTCCTGTCGACGCCG
GAGTACGCCCAGGAGGTGCTGCAGGCGCAGGACGTCGCCTTCTCGAACCGGCCAGC
TACCGTCGCCGCCATCTACCTCACCTACGACCGCGCCGACATGGCGTTCGCGCACTA
CGGGCCCTTCTGGCGCCAGATGCGCAAGCTGTGCGTGATGAAGCTCTTCAGCCGGCG
CCGTGCGGGGACCTGGCTCGCCGTGCGCGACGAGTCCGCCGCGCTCGTCCGCGCCGT
GGCCCGGCGGAGCGGCGAGTCCGTGAACCTCGGAGAGCTCATCTTCAACCTCACCA
AGAACGTCACCTTCCGCGCCGCGTTCGGCGCTGACGCCGCCGGCGACGCCGGGAAA
CGGGACGAGTTCATCGCCATCATGCAGGAGTTCTCCCAGCTTTTCGGCGGGTCCAGC
ATCGGCGACTTTATCCCGTGGCTCGGCTGGGTGGACCAGGGCCTCAACGTGCGCGCC
CGCACCGCGCGCGCCGCCCTGGACGAGTTCATCGACAAGATCATCGACGAGCACAT
GAGGAGAGGCAAGAACCCCGACGACGTGGACGCCGACATGGTGGACGACATGCTC
GCGTTCCTCCCTGAGGCGAAGCCAAGAAGGACGCTGGCGACGACCTGCAGAACTC
GCTCCACCTCACCCGTGACAACATCAAGGCCATGATCATGGTATGGATACCGGAACT
CCCATTTCTAATTCACCCGCAAAAAGAAAAAAAGGAACTTCCATTTTTAATTTGTTT
GATTCATGGTATGGTGCGGTAAACTGAAGTGTGTATGTGACAGGACGTGATGTTTGG
TGGCACGGAGACGGTGGCATCGGGGATCGAGTGGGCAATGACGGAGATGATGCACA
GCCCCGACGACCTCCGTCGGCTGCAGCAGGAGCTCGCCGACGTGGTGGGTCTCGAC
CGGAACGTGGACGAGTCGGACCTCGACAAGCTCCCCTTCCTCAAGTGCGTAATCAA
AGAGACGCTCCGGCTACACCCGCCCATCCCAATTCTGCACCATGAGAACGCCGAGG
ACTGTGTCGTCGGCGGCTATTCAGTGCCCCGGGGATCCAGTGTCATGATCAACGTAT
TCGCCATTGGCCGCGACGCCAAGGTGTGGAAGGACGCCGACACATTCCGACCGTCG
AGGTTTATGACGGGGGAAGGGGAGGCCGCAAGGGTCGACTTCAAGGGCAGCTGTTT
TGAGTTCCTGCCCTTCGGGTCCGGCCGCCGCTCATGCCCGGGGATGGCGCTTGGCAT
CTACTCACTGGAATTTGCTGTCGCGCAGCTCGCCCACGGGTTCAGCTGGGCGCTGCC
CGACGGCATGAAGCCGTCGGAGCTCGACATGACCGACATCTTCGGCCTCACTGCGC
CGCGCGCCACCAGGCTCTGCGCCGTGCCCACGCCCCGGCTTACTTACCCTTTGATCT
CTGATGTTGATGCCACGCACAAGGCGTGACGTCAAGTCGTATGCGCGCACAAAAGT
ATATTCATTATGTAGCACAATAAAGATGTTTCACTCGATTCAGGGTAACACTATATG
AGCTTATATTAGACGACGGGTCCATGGATTCAAAATCGAGTCAAACTTTGTAAACAT
TGACCAAGCGATAAATCACGAGTGGACATGCGGCCACGCAAGGAGGAAATCAGCTC
CGTCCACTCCCGCGTGATTCGTGCACTTATTATACAACCAGCTTGTATAATAAGCATT
GTATAGTCTTTGTATTAAATCAGAGAGGGCAGCTGTAAGTCCCACACGTCAGTTGCA
TGGAACGGCCCGACATGCAATTAATCAGTCACCCATTACAACGGCTAGCTGCAGCCT
GCAGCATACTCCTCTCGTTGCCTGCACCACGCTCCTCCCTCTTTAAATCACTCAGGCC
TTCTTCTTCCTCTGCCCAATTTGCTTCTACTATTTGCTCTTTCTCTCACACACACTT
TCTAGCATCGAATCGACCCCTTTCACAACCATGTGTTCATCCATGTCCCAAGCTATCT
CTCCACCACCTTCATCTCACGTCATTTCCCAATCAAATTGCATCTCTTCCTCTCATAT
GCTGCCTCGAGTGCCACCCTATCTACGTGCTCTGGTTCATTCTAGAAGTGGGAGAAA
CAACTACATACAGTTCTACAGCGCCACATGAGGTCAACTCATATCGCACTCAACAGT
CTACTGCCATGTCCCACTTTTCGAAGATAATCAAGCTTTGCTGAAGAAGATAACCAG
CCATGCATCAGCCATTGCCGTGCTCTTCCTCCACAAACACGAAAACTTAGTCCCAGG
CTGCAATCGTCGTCTACTTCATTTACTTTTCAGTTTAGACCTTATCTCAATCCAAACC
AGCCATGCATCAGCCATCAATTTTTTTTCTCACCAAGGTCGTCAATGTAATAGCTAG
TAATTTCAGTTTGGACCAAGCTACTCAATGTATGATCCAGTATTGGCTGCTTGTTATA
ACTACCCACTCACATTGTAAATGCCTGCCAGCAATCAAGGCACCCAGGAATAATTA
ATGGCTTCATTTATCCAGTGTACTACCTGCTCAGCCTGTATTCATTTATTAGGAGCAG
GTCGTGATTCGTTATCCTTGGCCATAATCACAGTTTGGTATTTTAATTTTGTCACATG
TTTTGGACTACTGATTTACAACTGAAATCTTTACATGTATCATTTTCTCACAAAAAAA
ATCAGTTAGCTTCATTCTTCATTGTTAGCTCGAATCATGAAAATTACAACTTGAATGT
AAAACACAACATCAATAAAAAATCAGTACACAGATTCTACATAAAAGTTAAAATAT
TTTTACATGGCTTATAGAATATTTTTGCGGCTTTGATTTTGATCTCAGCTTCACAATC

-continued

SEQUENCES

ATACTTGTTTACCAAAAATTATAATTCTCATTGACAAATTAGAGACATCAAAATCAG
CTCCACAAATTCCTAAGTGAACTACAAGCAGCATTTAATTACCAAAATGTATATTGA
AAGTTTGTCATGGTTGCAGCTAAATTTGTGTGCTTAGTCAAAATGGTAGATTAACTG
TGGCACAACGAACCTTAGCCGAAGCCAATCACACTTGCTTGCTCTCCACAGGGACGC
AACTTGAACAAGAGCTACAAGGCATGCCATGAGCAAGGCCGATGCTTCTGGACGGC
TGCCCCACGTCCACAGCAATTATGACTGACCCAACATGCAAGGGGCGTCGCTATTAG
ATGAGCCGATATTCATACGAAAACTAAATGAGATCTGGCCCACATGTGCAAGGTAT
AACATTGTGTATTTATGCTGGCCTGTGAATTACCTGCTCCGTATTACGCAGAGGCCT
ATATTAAGTAGCAATCGCGATGCACATGCAGACGCTTGAGATTTCGGCATCACGTGC
CACCATGTCCCAAAAATCCGCGTCGTTGACCAAGTCCATAGACTTTTAGATTCCC
CATGAAACATATCGTGCATTTGTGGGAGCACTTGCTACAGCCAAGCATGCATTTTTA
TTCCCTCCGTTCCTGAATAGTCTTTTAGAGATTTCAATAAGAGGCTATATCCAAAGC
AAAATGAGTGAATCCATACTCTAAACTATGTCTACATACATCCGTATATAGCT

SEQ ID No: 96
>Wheat_A0A077RQ37
CTGCATTTGAATAGTGTCATTTCTATTGTTTGTCTTCGAAACTCCCATGTTT
TGAAGACTTCCATAAAAATATTCACCCCCCCCCTCTAGTCGATAACTATCCCTTTCA
CCTTCTCTGGTACTCTGCCGGAGGGGAATCAATCACGGGGGCTTCTACATCATCC
TTGCTGCCCTTCCGATGATGTGTGAATAGTTTACCACAGACCTACGGGTCCATACCT
AGTAGCTAGATGGCTTCTTCTCTATCTTTGATCTTCAATACAATGCTCTCCTCGATGT
TCTTGAAGTTCTATTCGATGTAATCTTCTTTCACGGTGTGTTTGTTGGATCCGATGAA
TTATGGGTTTATTATCATATTATTCATGAATGTAATTTGAGTCTTCTCTGAACTCTTTT
ATGCATGATTGTTATAGCTTTGTATTTCTCTCTGATCTATCCGTTTGGTTTGGCCAACT
AGATTGATTTATCTTGCAATGGGAGAGGTGCTTTGTGATGGGTTCGATCTTGCGGTG
CTCAATCTCGATGACAGAAAGGGACATGACACATATTTGTATTGTTGCCATTAAGGC
TAAAAAGATGGTGTTTATTCATATTGATTGTGTTTACTTTTGTCTACATCATGTCATC
TTGCATAAGACGTTACTCTGTTTGTATTAACTTAATACCCTATATGCATGCTGGATAG
CGGTCGATGGGCGAAGTAATAGTAGTAGATGCAAGCAGGAGTCAGTCTACTTGTCT
CGCACGTGATGTCCGTATACATGATCATTGCCCTGAATATTGTCATAACTATGTGTCT
TTCTATCAGTTGCCCAACAGTAATCGTTTTACCCACCGTATGCTTTTGTTCAAGAGAG
AAACCTCTAGTGAAAACTATGGCCCCGGGTCTACATTTATCATATATAAATTCCAAA
AATACCTTGCTGCAATTTATTTACCATTATTTTTTTGTGTTTTATTTTATCTATCTATC
ACTACGAGATTTGATCCTTGCAAATAATCGTCGAGGGGATTGACAACCCCTTGATTG
CGTTGGGTGCAAGTATTTGCTTCTGTGTGTGTAGGTACTGTGGCCGATGTTACGGTA
CTCGATCCCGAGGCACACTCCGGCGTTGAATCGCAACCGAGAGAGCGGGCATTTCC
TACTCTTGAAGGACTTCTTCGAACACCAAACCCGCTCTTCAAACATCACCTATTTCC
ATTGTCGTTTCCGTATGGCTAGGTATGTTTTCAACCGTATCCGAGAGGGAGTGGTGT
CATACGGTAAGTATTTCGAGTGCAAGAAATATGCCCTGGGAAAGATTGGCTTCTCCT
CTTATCAGAAATGCAATACAGCTATTCGGATGCTTGCATATGGAGCTCCCGGTCTCA
TTGATGAGTATGTCCATATGAGCGAGTCCACGTGCCTAGCTGACGGTATCTATCCTC
AGTGGACTACTCTTGTGAAGACAACCTCCAATCCTGTAGAAGAGAAGAGGAAGAGA
TTTGCCCAAGAGCAGAAACTTGGAGCACTAAGAAGTTGTGGAAGGTGATGACTGCT
TGTGTGAGCATGCATAATATGATCGTAGAGGATGAGCATCCGAAACGTATCTATGAC
CAAGGGTTTCAGTTTCAGGGTGACAATGTTGTTCCTGAGCATGGAGGGATAACGTTT
TGCACAGTTTTCCAATTTCATCATTAAATGCGTGATTGAAAATTTTGCATTCAGCTGC
AAAATACTATCCTCATTGGATTTGAAATATGTGGATTTCAGGAGCAAAATATGAGGG
CCCGTCCGGATGCGTCCACGTCCACGGACATAGAGAAGTCGGATTTGCACGTCCGGT
TATAGATGCTCTTAGATCTCACTCGTGAGCTTTGCTGATTTTTGGGCCGGCACCCTCG
AACTTTTCTCCTCGGCTCTACTCGAAAAGCGTTACTCCAGTCTAAAACCCACACAGT
AGAATACCCCAAGAAGAAAACAATAAGAACTAGAGCTTCTAGTTCGAGTACCAGCA
ATGGTGGGCTTGACCAAGATCGCCATGGAATGGCTCCAAGATCCGCTGAGCTGGCT
GTTCGTTGCCTCGGTGGTCTTCGTGATGCTGCAGCGGCGGCGGCGGCGGGGGCAGGGC
GCCGCCGCTGCCTCCGGGGCCGAACCCGCTTCCTATCGTCGGCAACATGTCAATGAT
GGACCAGCTGACGCACCGTGGCCTCACGGCGCTGGCGAAGAAGTACGGTGGCTTTC
TCCACCTCCGCCTGGGCAAGGTCCACGCCTTTGCCGTGTCGACGCCGGAGTACGCTC
AAGAGGTGCTGCAGGTGCAGGACGCCGCCTTCTCCAACCGGCCGGCTAGCCTCGCC
GCCACCTACCTCACCTACGACCGCGCCGACATGGCGTTCGCGCACCACGGGCCCTTC
TGGCGCCAGATGCGCAAGCTGTGCGTGATGAAGCTCTTCAGCCGGCGCCGTCCGGA
GACGTGGCTCGCCGTGCGCAACGAGTCCGCGGCGCTCGTCCGCGCCGTGGCCCGGC
GGAGCGGCGAGACCGTGAACCTTGGCGAGCTCATCTTCAACCTCGCCAAGAACGTC
ACCTTCCGCGCCGCGTTCGGCGCCGGTGCCGCCGGCGACGCCGGGAAGCAGGAGGA
GTTCATCGCCATCCTCCAGGAGTTCTCCAAGCTCTTCGTCGAGTTCTGCATCGGCGA
CTTCATCCCGTGGCTCAGCTGGGCGGACCCGCAGGGCATCAACGTGCGCCTCCGCGC
CGCACGCGCCGCGCTCGACCAGTTCATCGACAAGATCATCGACGAGCACATGAAGA
GGGGCAGGAACCCCGACGACGTCGACGCCGACATGGTGGATGACATGCTCGCGTTC
CTTCCGGAGGCGAGAACCAAGAAGGCCGCCGGCGACCGCGGGGACGACCTCCAGA
ACACGCTCCGCCTAACCCGTGACAACATCAAGGCCATGATCATGGTACGTGGTAGA
TCCAAACTTCCGTCAATTATTTACTGCCATATGCGCCAAAAATAGATTTTTTCTAAGA
ATTAGGTAAGCTTCAGTCAACTCTCTAGCTCCCAGATCTAGACATCAAGAGCCGTGT
AGAATTTCTGTATTAGATAAAAAAATGTTTGTTTATTGACACTAAGAACCGGACCGA
CTCCGTCAACTTTTAAATGCTTATTATACGAAAAGTAGCCGCTACACTCGGGGTGTA
CTACACCCGACTTTGCAAAACAACTGAAAAAACGTTATCAAACCAAATCTGAAAA
TCTGAGACATCAAACCTTATCAAATGTTCGAGCTTCTTGTAAACTTTCAGCAACATT
GATTTTGTCTTTTTATTCGGTGAGAACTCCTCGGATGTTATTTTTGGCTGAAATTTTA
CAAGATCCTCAAACATTTTTATAAAGTTTATATGTTAAATTTTCAGATTTTTCAAATT
TGGTTTGATCATGTTTTTTCAGTTTTTCACAAACTTGGTTGTACTAAACCCACGAGTA

```
GAACATCTACTCTGACGCTTATAAGGTACTCCCTCTGGTCCATAATGTAAGACGTTTT
TTAACACTAGTGTAATGTTAAAAAACGTCTTACATTATGGGATGGAGGGAGTAGATC
TATCGTTCAAATGTAGTGGCGGTGCACAAGCCACTAACTTCAGATCAACTCGATTCT
TAGCTCTAACTTCAGATCAACCCAAAAGAAAATGAGTTACTATTAGCCTCCTTTTGC
AGCTCGGCTACAAAATGAGCTGAGTTTGGTCGCAAGTCTTACCTCGCTCGATTTTAC
CTCGACATAGCTCAGAATACTCCCTTCGATTCATATTACCTGTCACTCAAACTGATGT
ATTTAGTCATCCAGATACATCCACTTAAACGGCAAATAAGTAATATGCGTCGAAGAG
AGTATCATAATGTGTTTTTCTTTAATAATACAGGGAAGCTAAAATGTGTTTGTTACC
AGTACTATGTTTTTTAAACTAAAATGTGCATGCATATATGTATGTATGTACGACAGG
ACGTGATGTTTGGCGGGACAGAGACGGTGGCGTCGGCGATCGAGTGGGCAATGTCG
GAGATGATGCACTGCCCCGACGACCTCCGACGTCTGCAGCAGGAGCTTGCCGACAC
AGTGGGTCTCGACCAGAACGTGGACGAGTCGGACCTAGACAAACTTCCCTTCCTCA
AGTGCGTCATCAAGGAGACGCTCCGGTTGCACCCACCCATCCCATTGCTCAACCATG
AGAATGCCGAGGACTGTGTCGTCGGCGGCTACTCCGTGCCCCGGGGCTCCCGCGTCA
TGATCAACGTCTTTGCCATCGGTCGTGACGCCAGCACGTGGAAGGACGCCGACGCG
TTTCGACCTTCAAGGTTCATGGAGGGGGAAGGGGAGGCCGCTGGGGTCGACTTCAA
GGGTGGGTGCTTTGAGTTCCTGCCGTTTGGGTCCGGCCGCCGCTCGTGCCCTGGCAT
GGCGCTCGGCCTGTACTCGTTGGAGCTCATTGTCGCGCAGCTCGCTCATGGGTTCAA
CTTGGCACTCCCTGACGGCATGGCGCCGTCGGAGCTCGACATGCGTGATGTCTTCGG
CCTCACTGTTCCACGTGCCACCAGGCTCTGCGTCGTGCCCACACCTCGACTCACCTG
CTCTTTGGTCGCTGATGATGATGCCGCGCACCAGGCATGATGTCATGCGTGCACCTA
TTGTCTTTGTGTGCCCCACCGCCTGAGTTTGGTGGGTTTCTCTTTGCCTTTTCTTCTT
CTATTTTCTGATACTACAGAACACAATAATTGGATCTTCTATCCTTAGCTTACAGATT
GTGATGCGTGGCTATTTTTCATGTATATTTTTTGGGAGGGGGTAATGACACATGAA
GCAGGCTCTACCATGAAGATCCATATTTCGGTGGTAGTTTGAGCATTGCACGTTTCA
TGTCATCATCCTCGCTTGTTGCGACGAGTTGTTGAGCAATTATACAACAACGATTGG
GATAACCCACTACAGCAATAGAGACATGTTTTTTTTTGCTTGATTTTTGACTTTCTA
GTTGGCTTTCTCCCAAGAACATGGAGTACAATAGGAAGTTAGTAAAAATGTAGGATT
TAAAGATGTACTAAATTTCAAAAATGTGCACGAAAGTGAAAAATGTTCAGAAATTTT
AAAAATAGTCATGTTCTAAAAACACGAATTGGAAAAATATACACTAATATCAAAAA
ATGTTCACGCATACAAAAATGTTTGTGACCTTTAAATTTTTTGTCAATTAAAAAAAT
CAAATGTTTTGAAAATAAGGTAAAAGAAAACCGAAAGAAAGAACCGACCCTGCTAG
CCACTCCGCCCGCTTCTCGTTCATGGTAGTAGTAGCGGGCGTTCTCTTGAGGCAAT
TCGAGCCGGTTCTCTCAGTTTTTTTTCTTTTTCACTCTTTTTGCATTTGTTTCTTTGGT
TTTTTTTATTTATTTTTCTTTGATTTATTTTGTTTCAGTTTTTGTTTTTAATTTTTTAGTT
TTCTCTGTTTCCTTTGGTTTTAATTCTACATTTTTGTGTATGTTAACAACATTTTTCTT
CACATTTAACATTTTTTCAATACAAAAACTATTTTTTAATATATGGTTAAGATTTCCC
TATCACATTTTTAAATGCTTGATTAAAAAAAATTGCATACAAGATTAAAAAATTTAAT
ACATGGTCAACATTTTTCTATACACAACTAACATTTTCCATACCCTTGATTAACATTA
TTCAAATACTTGTTCAATATGTTTTTCAAATGCTTGGTTAAAAAATTATATACATGA
TAAAAAATTCATTATTTTTTAATACATAGTCAATATTTTTATACATATTTAAAAA
ATTCAAATACTTGCTCAATGTTTTCAATTGATTAACATTTTTATATACATGATCAAA
AGGATTCATCATTTCTTAATACATGATCAACAATTTTTTATACACGTTCAATATTGT
ACAAATTCTTCATTCACATTTTTCAAATACTTGTTCAACATTTTTCAAATGTTTTTAA
AAGTATAAAAAGTACAAAAATAAAGCAAAAATGAAGAAAAAAATAGGCTGTGGC
TAGTCAACAAGGCCCAAAGTGGTCAACAAAAGTCAAGAAAGCTCAGGGAAATCAAC
ACAAGTCCAAGACAGACAACAAAAATCCAAGCAAGTTGTCGTTGTCAATAAGTCAC
AAGAGAAGGCAAATAAAAGGCCCAACTAGCCAAAGGCCCATTCATGCATGGATGA
AGCTGAGTGGTGCACCGTAAACTATGGAGACCTTCAACTTTGGCCAATTTTCATGGA
CTCATGGGCCTAGTTTTATCGCACTACACCTCCTACATACCCACCACCATGGGCAGC
ATTAAATCATTTGTCAAGGCACACCCCCTGTATAAGGCCTCCATAGGCATGTAACAG
GTTCACTCACGTCAATAGACTAAGGGGAGGGCACTAGAGATCTTCGAGTTTTGCTCC
TAAAATGCTCTAGGATCGAGTCCGAGGAGCCGCATCGCGACTCAGATCGACGCTAG
AGATCTAGAAGCCTGCTCTCAAGACGTTGTAGGGGCAAGTCCTTGGAGCCGTATCGC
CTCTCGGATCGACCTCGGTCGAGAGTTAGGGAGAGGGTTTCAAGGAGTCGCGTCAT
GACTTCGAGCCTACGACAGTCCATCCTACCC

SEQ ID No: 97
>Wheat_W5AC21
AGTCATAATAGGTTAAGTCTTAATCCGACTTGGACTCTACATGTAAGCCA
CTCCTTGAACTTATATATGGAGGGGCAGGTGACCCTAAGAGGGTCAAGTTTTTAGAG
GGTCACAGTAGACAGGTTAAGATAGTCAGGGCTTTGACAGACAAGTCTAAAACAAG
ATCAAAGTAGATGCTCTCGAGATAGAGGTAGTGAAACACGATCATCATCATCAATA
TCAATGAAGTAGGATGTAGGCTTTTACCTCCACCGCGAGGGCCCGAGCCTGCGTAAA
ATCTTGCGTCTCTCGTCCCACTCAACCCCGCTCAAGCTACCATTTAGATGAGTTGGCC
TCACGACTAAGTCCTCACACTAAGATATCTGCCGTGACAAAATCACGACAACGAGT
GTTGTCATCCGTGGTGGTTGTTGTTGGGTGGTCGAGTTCGCTTCGACAGGAATCTAG
TGGTTGCATTTATTTTTCGTGTTCGTATTGGTGTTGGTTGTGTGCCTCCCAATCGTGC
AAAAATCGAGCATGCGACCCCTTCGGTAAATAAAATTCGCCGTTCACCAAATGACTG
CAATTTAAACACCAAGAGACAGGACGCATCTTGCTGTAAACGAGAACTTGGGAGCT
GTGGCTCGCTGACTCCCATTCATTAGAAAACTGACATATCTTATCTACTACTACTATA
TATAGTCTAGCACTGAGATCGATCTGGAATCGTTTCGGCCCCAACGCGCATCTCTGC
TCTCTGCCGCAACATATATATCTCTCGGCCCCAATCATTCTCGGTCCATCTGCCGTTT
GGCTACGTGGCACTTCTGGCCGGCCCTGTTGGCATGAATACGTGGCCCATTACAGTA
TTGATTAGAGTACGGTCAGAACTAAAGAATCCACAAGATAGCACGCCGTGCAGGTT
CCTGCATGCTGGGAATCTTTAGGACAAAAAAAAAAGTTTCTCATGTTTTTGTTCACA
GCGGCGATTAATAAGGACAAGCTTGAGCCAGCGAAAATTGACATATGAGATCGGGC
```

| SEQUENCES |
|---|
| ACTTTGTGCCCGTTATTTTGGAGTTCGAAAATTGCATTTATACGGCTTGAAAAAATTC |
| CAAAATTTTATGTACATGCTATAGCAGTGTAGTATAACATGCCAAAATTTCGCTAAT |
| AAACATATGCTTGCATTGCATGTGAGAGCTAAAAAAGACAAAATACATGCAAATTT |
| GGGGCCAGTTTTTTTCGATTTTGAGCTAATTTTTCGCCTTTTTTGTGCAGTGTATACA |
| ATAATGGGCACATGCATGCGTATTCATGTGTTTTTTTTCCAAAAATTTTAAGCACTTG |
| TTTTGGTGGGTTCAAAATAAAGTACTCCGTTGCCCCATGTTCTGAAAATCCATTTTAT |
| TAAGTCAGGCCCTGATCGATGATAAGCCTAGTCAGATGCTTATTACTGTAAGAACCG |
| ATGCAGAGATGCCTGCAGTAAATTGTTAGGAAACAACATCCGTATCTTGTGAAATTA |
| TTTACAACAAGTACGATCTGACATGGATACTCTAATTTAGATCACAGTATCCGTGCA |
| TATGGGTACTAGTGCTGCAAAAATCTCTGCTGGTTTTTGGCATTGTTATCTTGATCCA |
| GATAACAAATCGACATGGCTTGTGCAATGGGATTCCATTGTTGCATCAGCTCTCATA |
| ATTAGGCTAATTTTGACAAATTACCAGTAGCATGCTGAATTCCAAGCATACCACTAA |
| ATTGTCTAAACCTACAAAGTTTCTCCACCGGTGCCTCCTTTTTCTAAACTTTGAGCGA |
| CTGCTGGCCTGACTTCACACGACGCATCTTTAATATGGTTCAAAAAGACTGATGTAT |
| TGTTTCAGCTGGTCTGCCTCATCTCAATTTCGGGAGAATATTATACGGAAACCAATA |
| TTAATAAAAAATTGTGAAAATCATATTTTAAAGTTTTGAAAAAATCTGAAAAAAAAT |
| TCGGAATGTTAAGAGTGTGATGTTTATTGCCACGCAATTTCATGTTGAATTTTTGCG |
| TGGTAATAAAACATCACCCTCTTAACATCCCATATTTTTTTCAGATTTTTTGAAACTT |
| TTAAAATATGGTTTCCACAAAGTTTTCATTAAATTGGTTTCCGTATGATATTCTTCCC |
| TCAACTTCTGCTCCAACTATATATTACCCGGCATCCTCCACTCTTTTCCTTACCCTCTT |
| ACAACACATCAACCTGAAACCTGCACTGCACAGTCGAGAATTCTCCAAGAAAAAAA |
| AGTTAGAGCTTCTAGTTTGAGTATCAATAAATGGTGGACCTGTCCATGATCGACATG |
| GAATGGCTCCAAGAGCCATTGAGCTGGCTGTTTGTTGCCTCGGTCATCTTCGTGTTGC |
| TGCAGCGGCGGCGTGGCAAGGCGCCGCCGCTGCCCCCAGGACCGTATTCACCGCCG |
| ATTGTCGGCAATATCTTCATGATGGACCAGCTGACTCACCGGGGCTTCGCAGCGCTG |
| GCCAAGCAGTATGGCGGCCTTCTCCACCTCCGCCTTGGCAAGGTCCACACCTTCGCC |
| GTGTCGACGCCGGAGTACGCCCAGCAGGTGCTGCAGGCCCAGGACGCCGCCTTCTC |
| GCACCGGCCAGCAACCATCGCCACCACCTACCTCACCTACGACCGTGCGGACATGG |
| TGTTCGCCCGCTACGGGCCATTCTGGCGCCAGATGCGCAAGCTGTGCGTGATGAAGC |
| TCTTCAGCCGGCGCCGTCCTGGGACCTGGCTGGCCGTGCGCGACGAGTCTGCGGCCC |
| TCGTCCGTGCCGTGGCCCGGCGGAGCGGTGAGCCCGTCAACCTCGGCGACCTCATCT |
| TCAACCTCAGCATGAACGTCACCTTCCGCGCCGCGTTTGGCGCTGAAGCCGCCGGTG |
| ACGGTGATGGCCGGAAGCAGCACGAGTTCATCGCTATCATGCAGGAGTTCTCCAAG |
| CTCTTCGGCGCGTTCAGCATCGGCGACTTCATCCCGTGGCTCGGCTGGGCGGACCCA |
| CAGGGCATCAAGGTGCGCCTCCGCGCCGCGCGCACCGCCCTCGACGAGTTCATCGA |
| CAAGATCATCGACGAGCACATAAAGAGGGGCAGGAACCCTGACGACATGGACGCC |
| GACATGGTAGACGGCATGCTCGCGTTCCTCCCTGAAGCCAAGCCGGACAAGGCCGC |
| GGGCGACGACCTGCACCACACGCTCCGCCTCAACCGTGACAACATTAAGGCCATCA |
| TCATGGTACGTAAGCATCACCAAACATCCATTATGTGTTGTTAGCCTCTATATATCCG |
| TCTACCATGTTTATTATCTATGATGTTTTCTTTATTTTCGTTCTCTATTGTTTTCTGAAT |
| TCCTTTCCAACAATTGAATCTTGAATCAAAAAGTGGTTTGGTATGTCATGTGAATAT |
| GGATATTAAATTAAAGCATATGTTTGAAAATATTCTTGCTGACTTAGTAGAATATTT |
| ATGTCTCTATTGCATATACACCGACAATTAATTAGTAATCAAAATGAATTTGTGCCA |
| TCCAACATTTTTTCGGAAACAATTATGGAACCTTAACACTGTTCAGCCAACAACACC |
| ACCCATTGAACTTTCGTCATCCATGAGACTTCTATGTTTTTCTAAGTGACATACTCCC |
| TCCGTCCGGAAATACGTGTCCTAAGAATGGTTGTATTTGGACTTGTTTTAGTTATAGA |
| TATATCCATTTTATTTATTTTTAGGACAAGTATTTCCGGACGGAGGGAGTATGATATA |
| CTGTAAGTACTATCAGACTGCTCTGTTTGTGTGTGTGTGTGATAATAAAGTAATGT |
| GTTGACGCGGCCTGCCTGCAGGATGTGATGTTTGGCGGGACGGAGACGGTGGCATC |
| GGCAATCGAATGGGCAATGGCCGAAATGATGCACAGCCCAAATGATCTCTTGCAAC |
| TGCAGCAGGAGCTCGCCGACACGGTGGGTATCGACCGAAATGTGGACGAGCCGGAC |
| CTCAACAAGCTCTCCTTTCTCAAATGTGTGATCAAGGAGACACTCCGGTTACACCCT |
| CCCATCCCGCTGCTCCACCGCGAGAATGCCGAGGACTGCGTGCTTGGCGGCTACTCC |
| GTGCCCCAGGGCTCGAGCGTCAATATCAATGTCTTCGCAATGGGCCGCGACACCAA |
| GGTGTGGAAGGACGCCGACACATTCCGTCCGTCACGGTTCATGGAGGGGGAAGGGG |
| AGGCAGCGGGGGTCGACTTCAAGGGCGGGTGCTTCCAGTTCCTGCCGTTTGGGTCTG |
| GTCGTCGTTCGTGCCCCGGGATGGCTCTCGGCCTGTACTCGCTGGAGCTCGTTATTGC |
| GCAGCTCGCCCATGGGTTCAACTGGGCGCTGCCCAATGGTGAGAAGCCGTCGGTGC |
| TCGACATGAGTGACATTTTCGGCCTCACCGCACCACGTGCCACAAGGCTCTGGGTCG |
| TGCCCACGCCCCGACTTACCTGCCCTTTGGTTGTTGATGTCTGACGCCGCGTGCCAG |
| ACATGATATCGTGAGCGCACAGCTGATGGTATCTACCAGCTGCGCAGGGCGTGATG |
| GTGTTTGATCAGCGTGTTAGTTAATCTAGTTGTAGCTGTAGCTATTTTCCCCTTTTGT |
| GTTAGATATTTCCTAGCTTCGTTTAGACACGATCGCACCCGTATAAATCGGCTGCCCT |
| GGACGTGGAATTGTGGGCATCGTGGAGCCGGGTCACGATCGTTCCTTTCATCATGAA |
| TAAAAAGGAAATGAAGAATGACAGAAAACAGGAAGTTGTTCGTAGCACAAATGTT |
| TACACCAGCATGTTATTCTTGTCCTTTGTTTCTCCTCCTTCCGCGAACTTGGTTGATA |
| ACGATGTTGTTTTCATTTTCGAGAGTTAGTTACACTTTTGATATATAAACCTGCAATT |
| GATGTACATATTCATACGTAAACTTGAAAAAATGATACAAATCGGTGCTACAACTTG |
| TGTTTCAGATACATTCAAGTACATTTCGCTGATGACTCTCCGTTAAATTCTGCACGTT |
| AGTTTACCTACACTTCATATCTGCGCATGGGTCACGCAAAGAAAGAAAGAGAAATA |
| TATATATAGCAAAACCGAAAGAAAATAAGAGCGTACGCCGCGCATTGCCGCTCATG |
| GTAAGGCGCCCCAGCCCATCCACCTTTGACCTAGGCAGCCGCCATCTCCAAAATCTA |
| AGGTTTTCTGCCTCCCGCCGGCGCCGGCGCCGGTCCGTCCCGTCTCCGTGGCCTTA |
| GGGCCATGGAGACGTGGTGGATCTCAGCCCTTGCCGGTGGGAGGGCTCCGTTTTTAG |
| ATCTTTTTTTCAAGCTTTGTTAGGATTTGTATCCTGCTCAGGAAGGCAAGACGGCGGC |
| GGCTCCCTGAAGATGGAATAAATGTCTCCCCGCCTAGCCCCCCTTCCGGTGATGCGC |
| TTAGCATCATCGGTGGGCATGTGGAGGTGTGTCTCCGGCGGATCTGTCTTTGGTGGA |

-continued

| SEQUENCES |
|---|
| TTTGCTCGGATCTGTTCGTCGTTCGTGTTCTTTGTTTGTCCTCAGATTTGATCCTTTTG |
| ATCGACACTCTTCATCTGCGGCGGTTGCTGTTCTGGTGCGTTGGTTCTATGGACCCTT |
| AGCACGACGACTTCCCGACTGTCTACTACAACAACGTTTGCCCGGCTCCGGCGAGGG |
| AGGGGCGATGACAGCGGCGCGCCTTCGGCGCTTCAGTGCTTGTAGTCGTCGCTAGGT |
| GGTCTACGAATCTGGATGTAATTTTTTATTATTTTTAGTGTTTATTGCACTAACATGA |
| TTGAAGATGAATAGATTGAAAGTTTTTCCCGCAAAATAAATAAATAAATATATATAG |
| CAAAACCCATTGCGCACGGTTGGAATCAAACTCGGAAGGTTGCCCCCAACACTACA |
| CGTGCCAACCAATTCACCACGTGCAGCTTTCTATTAGCGCGCGTTATATATAGACAT |
| TCCTTTAGATGACTAGGAAACAATTATGAAGTCAAAACATACACTGCTAGATGAGA |
| GAAGTCCTTATTTAACACCGTGTCTAAATTTTATGCCCTATTTGACATCGACAAATAA |
| TGTCTTCCCTATCTAACAACGAGTCTAAATTTTATCCCTTTTATAACACTTCTGTCCA |
| TTTTGAGCCAAATGACACCTGAAAAGACCATTTTGCCCTCACGTGGTTTGTTTGTGTG |
| CGGGTGTGCGCGCGCGTACGTGTGTTCCTGCTTAGTGTGTGTGTGTGTGTGTGCAT |
| GTGTGTTTGCTATTGTGTGTGTACGTGTGTGTTTGTCACTGGGTGTGTGCGTGCATGT |
| GTGTGTGTGCGGGCGCGCTCTGTTGCGTGCATGTGTGTTGTGTGCGTCTGTGCTGCTG |
| TGTGTGCTACGTGTGTTTGCTGCAGCAGCGTGTGTGTGCTGCATGCGTGTGTCTGTGT |
| GCCGCGTGCGTGTGTGCCGCTGCATGTTGAGTGCTGCGTGTGTGTTGCCTCGTGTGT |
| ATGTGCTGCTACGTGTGTGCTACTGCCCTCGCACAGATGTTACGTGTGTGCTACTGCC |
| CTGGTCTGAACAACGTGTTTTTTCTTCTCTTGTTTGGTTTTATTCTGCGCAGGACCAG |
| ACAACCTGGTTTCCAAAAAAAATCTGAATTTCTAGTAGCTTTTTCTTCGAAATTTCCA |
| AACGGATTTTGAATTCAAATTTCAAACAAAATTGAGTTGAAAAAATATGAGTTTTTG |
| ACCGATATAAAATTGGGGGCTTACCAAAAATATTAAATGAAATTTAAATACATGCAT |
| ACAAGTTTATTTTACAATATCTGACCTTTTAAATTGAAAAAACTTAAAATTTTGAAC |
| GATATCAAAAACATTGGGGGCTCACT |
| |
| SEQ ID No: 98 |
| >Rice_Os03g0112900 |
| ACCACATGGTATTACATGGCACGTCAATTATAATTTAGGCATTTCGAGAT |
| GAACATGACGTACACACTTGTAAGATGAAGATGTTCTCTCCACACAACCATAACCAG |
| CCCATTACCCCTCACTATATATACTACCAACTTCTTCATCGGTCGTGCATTGTTGTAT |
| TCTTTCGCCAACTCGTTTCTTGTTTTCAAAGTTGTGTTTGAGTCTGTTCAAGACGAAG |
| ATGAAGTGCAGGTATGTAAAACCAGAAAGTCGTTAGCGTATGATTAATTGGGTTATA |
| ATTATTACAAACTTGGAAAACATATTTATTTGATATTTCTAAAAACAACTTCCATATA |
| AAAATTTCCGCATAAAATGTACCGTTTATCAGTTTAAAAAACGTGCTAACAAAAACC |
| AAGATAAATTTTGTATCTTAATCAAGTTAGAACGTATACCCACCAATGTTTGATCCG |
| TCAATTTCATATTGTATTGCTGATTAAGTTTGGTATAATTTGCCATTCTATTTGCTCTT |
| AAGGCTATGGTAACCACTGTACATCTCTTTGCATGTTTAATCACTAAATTCATGATTT |
| TATTTGCTGATCTTGCGCATATTACTGTGTTGTAGTTGATATTTTATTTGTATTCATTT |
| GCTCTGTTTTGGATCCAAGAGAATTTAATGTGTATGTACTTTCTGTTTAGTTTCAGGT |
| AGGATAATTGAAGTTGGATGATCCTACACCTCCCTTTAAGTATTTCATTCACTCCCAC |
| AACAACTGAATTATTTGTTTGGTGGCTGGGTGTCCTTCTTCAACCGTGCATATTTTCA |
| TTGTGCTAAAAATGTTATATTTCCTCTTGAGTTAAAGTGGTCTCAAATATGAAATACC |
| TAATAATGTTTTCCCTTTCTAATCCTAAATAAATTAAATTCCTGAATATTTCTTTGAA |
| AATGTTTTTTTAGTACATATGAAGTATACTGTATACCACATATGCTTCAGTATGTATA |
| TGTGTAAAGCGGCATATTAATTGGATATGAAGTGTATGGCGTAAAATCGGGTTAGAT |
| TATAATTGTAAATTTCAGTTCAATTTGCAGGTTTAAGCTGGTTATCCTTAGATTGAGA |
| GTTTTTAATCAGTTCCATGAATATAGAAATTATTGCTGTTTTTTCCCGGTTGTAATAA |
| ATCCACAGACAAGGTTATCTGAACCTTGCATGAACATACTCTTTAATACTATCTCCA |
| TTTTAAATACATAGTATTGTTTACTTTTAAACATATATGTCCATTCGTCTTATTTAAA |
| ACAAATATGCTAATATGCAAAAATATAAACTGTATTTAAAGTAACTTTAATAATAAA |
| ATAAATGATGTTAGCATATTTTCTAAATAACATGAATGATCAAATATATGTCTAAAA |
| ATCAACGGCATTATATACTAAAGAAAATGGAGGGAGTAGGAATCAGCGTATCTGCT |
| AAAATTAAGTCGGATACAACCTTATAATCTCAATATAACCTCGTAACCATTTTTCCTC |
| TTTGAGTGCCAGGCTATCTAACAACACTAGCTCCAAAAGTTCTTGATGTGGCATGGT |
| GGACATGAATTTGTAACTGCATGCAGGATTCCAGCTCAGAGAATTGCAGGCTGTTGA |
| TATCTCATCCCTGATTTCTGGTGCCCGTTATTGTATCATCTAGCACATTTAGAGCTGA |
| TGCTTTTGATAATTAAATTAAGGAGAAAAAAAAGAGAGGAACTGATGTTTTTTATCC |
| TAATCTGAGGAGAAAAATAAATAACAGTTGCTTTTAAGTCACTAATCTAAGGAGAA |
| AATAAAGAACTGATCTAACCACTAATCCAAGGATGAAAAAAATAACAGAGATGAAC |
| TGATCCTTTTGCCAAGAAACCCGGAAGAAATGATCCAGGAATGAAATAATCTTCCCC |
| AAACTTTCGTTGAGCAATTTATACTACGAAATTTCTACCTATATAAATAGGCGCATT |
| GCCCCTCTCCCATTTCTCACCAGCTTCGATCACATTCCGATCAAGCTGCAACAATGG |
| CGAACGGCGTGGCAGAGTACTTGCTGATGGACCCGTGGCTTGTTCTATGGCTCGTCC |
| TGGCCTCCATGGCGTTCGCATTGCTGCACCTGCGGCGGCGCACGCCGTGGGGCGC |
| CGCCGCTGCCGCCGGGTCCGCGGCCGCTGCCGATCATCGGAAACATGCTCATGATG |
| GACCAGCTGACGCACCGCGGGCTGGCGGCCATGCGGCCAGGTACGGCGGGTTGCT |
| GCACCTCCGCCTCGGCCGCGTCCACATGGTGGTGGTGTCGAGCCCGGAGCACGCGC |
| GCGAGGTGCTCCAGGTCCAGGACGGCGACTTCTCCAACCGGCCGGCGAGCATCGCC |
| ATCGCCTACCTCACCTACGGCGCGCCGACATGGCCTTCTCCCACTACGGCCACTTC |
| TGGCGACAGGTGCGCAAGCTCAGCGCCGTGCGGCTCTTCAGCCGGCGGCGCGCCCA |
| GTCGTGGCGCGCGTCCGCGACGAGTCGGCCAAGCTGGTCGGCGCCATTGCCAGGA |
| GAGCCGGCGAGGCCGTCGACCTCGGTGAGCTCATCTTCGGGCTCACCAAGGACGTC |
| ATCTTTCGCGCCGCCTTCGGCACGCGCGACGGCGGCGGCCACGGCGAGCTGGAGGT |
| TCTCCTGCAGGAGTTCTCCAAGCTGTTCGGCGCGTTCAACGTCGGGGACTTCATCCC |
| CTGGCTCGCGTGGCTCGACCCCGCACGGCATCAACCGACGGCTCCGCGCGGCGCGCG |
| CCGCCCTCGACAGCGTCATCGACAGGATCATCGACGAGCACGTCAGCAACCCCGCC |
| GGCGACGAGGACGCCGACATGGTGGACGACATGCTCGCGTTCCTCGACGAGGCCGG |

| SEQUENCES |
|---|
| ACGAGACCAAACCGGCGGCGGCGGCGAGCTGCAGGGCACGCTCCGGCTGACGCGC
GACAACATCAAGGCCATCATAATGGTACGTGCCATTCTGACACCACTGCCATGGCAT
GCACGTCGCGTTGCTTGATGGAGTTGGCGACGACAAGTGCAGGACTTCGTCTTCGGC
GGGACGGAGACGGTGGCGTCGGCGATCGAGTGGGCGATGGCGGAGTTGCTGCACAG
CCCCGGCGATCTCCGGCGGCTGCAGGCGGAGCTCGCCGACGTGGTGGGGCTCGGGC
GCGGCGTGGAGGAGGGCGACCTGGAGAAGCTCCCCTTCCTCAGGTGCGTCGCCATG
GAGACGCTGCGTCTCCACCCGCCGATCCCGCTGCTCCTCCACGAGGCGGCGGCGGA
CTGCGTCGTCGGCGGGTACTCCGTGCCGAGGGGCGCCCGCGTGGTGGTCAACGTGT
GGAGCGTCGGCCGCGACGCCGGCGCGTGGAAGGGCGACGCCGGCGCGTTCCGGCCG
GCGAGGTTCATGGCGGGCGGCGAGGCGGCGGGGATGGACCTCAGGGGCGGATGCTT
CGAGCTCCTGCCGTTCGGGTCGGGGCGGAGGGCGTGCCCCGCCATCGTGCTCGGGA
TGTACGAGCTGGAGCTCGTCGTCGCGCGCCTCGTCCACGCGTTCGGGTGGGCGCCGC
CGGGCGGCGTGGCGCCGGAGGAGCTCGACATGGCGGACGGCTTCGGCCTCACCGCG
CCGCGCGCCGCGAGGCTCCGCGCCGTGCCGACGCCCCGGCTCACCTGCCCGATGTG
ACGCGCGTTCTCGATTTGGCGCGAGAGATGCGCAACGCAGCTCGAAGTGTGACTGT
GACAGTGTGAGCGTGTAATCTGGTGTGGACATCGTATGCATCATGTGTGCTTATGGA
TAATTAAATATATAAATAATATTTGGATGTGGATTTCGGCTGAAATTTTCTGTCATTT
CGAAAAAAATTCGTCCTAGAATTCAAATAGAATATTTTTTTTCTCATTATTTTTTATA
GTTGCACATTGGCTACATTATCTGTAGAAGCTTCTTGATTCACGAGATCTAGCGGGC
GTGACAATATGGTCAAAGAATTCTTTACCCTAGACATGGGCGTCGATATGGTCGTAA
AGCTGCTCTTCAGCTTAGTAGCCACATCCATAATTTAATCTTAGGATTATTTTTACAG
TTGATTCCGATATTTTTTCATCGTAAACATGGGGTTTTACATCATTAAAAACCCACAT
ATAAAATCCTTTCCCTTAAAAGAATGATGGTCTTTGAAGCCCTTATTTCTTTTTTTAA
TCTTCGAGTATGTATGAATAGTTTGATTACGTGCATTTTAATTATGTAGAGATTTGGA
ATGCTATTCGACAATTATATTATCTTAATGTTACATTAAGTGAGATGCTTTTATTATT
TAAAAATCGATTATATTTTAAAACAAAATCTGAAGCACTCCGTGGACCGTGGTTACA
CGTGCCAGGTCGACGTGTTCTTCTGGAAGAAATCTATGTCTACTTTTGAAATGGAAT
ATACTACCTCCGTTAAAAATAAGTACAAACGTAAATAAATAAGTACAAACGTAAAT
ATCCGTATGAACGTTCGTCTTATTCCAAAAATTTATAAAAATAAATTATAAAAAAAC
AGTCACATATAAAATATTATTTATGTTTATAATCTAATAGTAACAAAAAAATATTA
ATCATAAAAGATAAAGAAAAATTTAAATAAGATAAACGCTGAATATAAATAATATT
TTATAAAGCTGTACTTATTTTAAGACGGAAAGAGTAAAAAATTTTGGAAAAATTTCT
AGTGCAGCATGCTGCTCATTTGGGAGGTGTGTGCTGCTGCTCTCCAGTCTCCCCCAA
CCAAAATTTGACCGAGTTTGGCACGAAAGAAACCGCCTCGACGCCGTCCAACGGAA
GCCAGCCGAGGCGACCAACCCAAGGGTAGGCCTAGGCGTAAACCCTGCACCTGAAT
CGATCGCCGGCGATGGCCACGACGCTGACGCCGACGCAGCGCTACGCGGCGGGGC
GCTGCTGGCGCTCGCGCTCCGCCAGGCCCAGATCCACCAGTCCGTCCTCCTCGGCGC
CCACCACCACCACGACGACGACGACGAGGAACAGGGGCGCACCAGCACCAGCAGC
GGCGGCGGCGGCGGCAGCTCCTCCTCCTCCTCCAACTCCGGCGCCGGCGCCGACGCC
GACCTCTGGACACACGACTCCCACGGCCTCCTCCGCCCCGTCTTCAGGTGTTTTCTCG
CTCCTCTCCGCTTGTAAATTTGGGGGTTTGAGATGAATGCTTCCGCTTTACTTGGCG
ATCGGGGGGCTCTGCTAGGTTCCTGGAGATCGATCCCAAGGCGTGGTCGGGGCTGG
AGGAGACGGCGGCGTCGTCCGAGGCCAAGCATCACATCGGCGCGGTACGGCACTCA
CTGCATTTTCTGCCCTCGTATTGTAATTGGCCGTGCGTTTTGGTCAGTGTTGCAGTGA
TGGTTTGGGGCTTAGGTGTTTGATTATATGCCTACAAGACTGTTCAACTTCAATTTCC
GCGTGTGCTTGACCAGTGAAATTTGTGTTTTCGTAGCATCTCTATATCACTCTCATTTT
GTAGTTTCTAAGGATAATATTCGAAGAAGATGGCGAAAGCTCCTCAGACAGATCCG
TTCAGGAGCTTGCCTTGGCAAAAGGAGTTGATGTGATGGTAATGAGTTTGGGCAATG
ACAGTGAAGTGGGTAACACAATTAAAGGTGGGGATCAAGATGCTTTGCCTAGCAGC
TCTGGA |

SEQ ID No: 99
>Rice_Os10g0512400
GTTGTCGCAGAACTTGTTACAATTGTATAGTCCTTTAGTTTTTTGTACTAAT
GTCATATTGGCAACACATATTCCTTGTTGAGTTGGTACTACCTGCATCAGCACCTTAA
TCTTTCCTAGTTTGCTCTGCTAATGATGAACAATGTTATCACCAAGTTAGAGCAGTTA
CGTAACTATAGAGTATTTGTTGTACAAATTTCTTAGCCTACTTGCCACTAATAATATA
ATGGCAATATATTCACTCTTCTTTACGAGAATACATCCATCAAAATCAGATATGATC
TTTGTATTATCAATAAATTGTTTATCTATGGGGTCCATGAATATGTGATTGTGGCTTA
GGTCGTGTTCGATTCAGCCGTCTGGCAGTATTATTGTTTGTAATTAGTATTATCTATT
ATAAACTTAAAAATAAATATACTTAATTTTAAGAAATTTTTATATAAAATTTTTTACA
CGAAATGTACCATTTAACAATTTTAAAAAGTGTACTTACTTTATGAGAAATGAGTAA
TAAAGCTCATCCGAGAATCCAAAAAGAACGAACCTTAATTAGGCCTTGTTTGTTTCC
TATTGAGTTTTTGTCTTCAACTTAAAGCCAACGAAAGCTTAAGGTTCTCGAAACGAA
ATTGTAGCTTCTCTACTTCTGGAAGAGGCTAAAAGCCAAAATGGAGGTTACAAATGT
ATCTATCAGCTGTGATCGGGCCCACATCCATACATTTCTTTAAAGAAAAAGAAGAAA
GAGAAAAAACTCTGTAGCTAGTTTTTTTTTTATTTTTTGAACTTTTAAATTTTAAAA
ATAAACCCTTATAAAACTTGTTTTCAAGATCTGAACATTTTCGTCACGTTAGCCAAA
CTGACTTGGCAAAACAACATTGTCACGATGGTTTGGCTGACGTGGCAGCATTATTTA
GTCACGCCGGTCTGGCTGGTATGACAATGTTATTTGACCACTCCGCCCTCGATGACG
TAGCAGAATAAAATTGTCATGCCCATTATGTGCGACGTGCCAGTGTTGTTTGCCAC
GCAAGACAGACGGGTGTTGCTAAAAGTTTCAGATTCTGGAAAAAAAGTTTTGGCAA
GGTTAATTTTTAAAATTAAAAAATAAAAGTTCAAAAAAAAAATTGTAGCTAGTATGG
AAGGTGCTGAGAAAGCAACTGAATGCAATTTTCCAAAATGGAATAGTTATGGATTT
GGCGGATACAATGAAAATAAGTTGAAAGTGAACATTTGTATTTGTTTTCTTGATCCA
TCCTTTAACCGTATATGGTGATGTAAACAGCTAGTCTTAAGAAAACTGAAAAATATA
TGGTGATGACTGATGAATACCAAATGCTAATCGTGTACGGTCGTTTAAGCATGTGCA -continued

SEQUENCES

CTAAATATACAAAAAGGAAATGTATCTGTTCAACATCTTGGATTAGACTAAGCATTC
ATGGATCTTCAGCCCAACTGTAGTATTGATTACTATTTGATATGAACAATTCCAGAC
CTCGTGTTGGACAAGTTCACCCTGTTACTTTGGCCGGCTAATTGCCAGTTTGCCAATT
GCCACCCACTTGCTCAGTCAGTTGTGTTACTCAGCTGTGCTAACGTAATTTCCATGCTA
TTGGCAAACCTAATTTGCTGCAAGATATGGAAGTGTCAATAAAAATATATTACTTTT
AATAGTAACGAAAATATAATAAGAGTTATGATATAGGATACTTCATATATCTAAAA
ATATACTAAATTCTAACGATGTATTTGGATATATTTATCTAAATACTAGTCAGAAGTT
ACTATATTTTGAGATGTGGATATATAGGTGTCATGAAAAATGATTGAAGGAGAACCT
TTTCGTGATATACTGGGACCCACTGCCTAAAAATATAGAGGAAAAAAAAACGAAAA
TGCATGTATCTATGGAAATTTGAGATCCTATACTAGTCTTAAACCAGATATAAAAAT
ATCATTCCTCACCTACTCCTCCCAACTCTATATAAACCCTGGATCATCCTAACTTTCT
CCTCAGCTCTACACCAAGAGCGCTTATAAACATAAAAAACATCTCAAACACAACCC
AAAATAGGGCCAAAATTCTAGAATATTATTTTTGTTTTGAAAGGAATTTAAGTTTGT
GTGGTGTGTCATCCATGGCGGACATGGTGAAGTTCACCATGGAGTGGCTTCAGGATC
CTCTGAGCCTGGCGATCGTCGTCACGGTGGCCGTCCTAATCATGCGGATGCAGCGGC
GGCGCGCGGCGCCGTTCCCGCCGGGGCCGAAGCCGCTGCCGATCGTCGGCAACATG
GCGATGATGGACCAGCTGACGCACCGCGGCCTGGCAGCGCTGGCGAAGGAGTACGG
CGGCCTGATGCACCTCCGGCTCGGCCGGCTCCACGCGTTCGCCGTGTCGACGCCGGA
GTACGCGCGCGAGGTGCTCCAGGCGCAGGACGGCGCGTTCTCGAACAGGCCGGCGA
CCACGGCGATCGCCTACCTCACCTACGACCGCGCGGACATGGCGTTCGCGCACTACG
GGCCCTTCTGGCGCCAGATGAGGAAGCTGTGCGTGGTGAAGCTCTTCAGCCGGCGC
CGCGCCGAGACGTGGCTCGCCGTGCGCGACGAGTCCGCGGCGCTCGTGCGCGCCGT
GGCGGCGTCGCGCGGCGAGGCCGCCGTCAACCTCGGCGAGCTCATCTTCAACCTCA
CCAAGAACGTCATCTTCCGCGCCGCGTTCGGCACGCGCGACGGCAGGGGCACGAC
GAGTTCATCGCCATCCTCCAGGAGTTCTCCAAGCTGTTCGGCGCGTTCAACATCGGC
GACTTCATCCCCTGGCTCAGCTGGGCGGACACCAACGGCATCAACGCCCGCCTCGTC
GCGGCGCGCACCGCGCTCGACAGGTTCATCGACAAGATCATCGACGAGCACATGGA
GCGCGGCAAGAACCCCGACGACGCCGACGCCGACATGGTCGACGACATGCTCGCGT
TCCTCGCCGAGGCCAAGCCGCACGCCGGCAAGGCCGCCGCCGCCGCCGCCGGCGCC
GGCGACGGGGCCGACGACCTGCAGAACACGCTCCGCCTCACCCGCGACAACATCAA
GGCCATCATCATGGTACGTGCAGTTGACAACCTACTAGTAATTAATTACTGCCAAAT
TTTTCACCAACTTAATCTCTATCACGGTAATGATTAATTACCACTTACTCCTCCCG
GCCGATCAAGATAAAACCCGATCGAAATTAGGCAACACCAAATCCGTAAAATTACT
GGAATTAATGATTCACCGATTAGAGCAAGTTTGATAGTATAGCCAACTATTAACTC
TAAATCATCTATAGCAAATATAATAGCTAATTTATACAATAGTTACTTACTATACTAT
TAATATCTGGTCCCACCTGTCATACACACATTACGTCTTAGAGTTCGTGCTGCAGCTG
GCTATAGATTTTGTAGCCCGCTGCTCTTTTCTCTCTTGCTTTATCTTTTTAAAATATAT
TTATAGTTGGCTTACTTATAGCCTGCTATTGTAACTACTCTTACACAGCACAGCAGTA
TGGAGTAGTAATATATATCTTAAACTCTGACAATTAAACATGATAAATTCATCTGAC
GCAAACACAACTGTACGCTATAAATACGCGTACAAATCAGCAACAGTAGTGTACGG
GGCCGGATTATTAGTCAGGTAATATATCATTTTATTTTAGGCGATTAAGTCAGGCAA
ATTATCTTGATCCGTGTAGATTATTTGACAGGGCAGAGATCTCTCCTGGTATAGTTG
ACATGAACACCATGTGCAGTCCATGTGTGTGTTCGCCTCGTTTGCAGGTGAATCGAT
ATGATCAACCGTTAGATGGCGCCACGTATGCATCATGGATCATAGATTAAGCCCTGC
AAATTAAAGCCACTCAATGAAATGCTAGATTTGAGGAGTAATTAATTTTAGTGTAGA
ATACAGTGGTCCTCCTTGATGCATCCCTCGCAATGTATCTGCACTTCTACAGGCAGTC
AACTCACTTACATAAGCATTGTCGACTGTTCCCGAGGAGATCGACACCGTCAGATAC
GGCATTAACCTATGATTATTTATACCCATATTTCAATATACGGGTAGTAAAATATTCC
GAGAATTTTATGGAGTAGCACGTACTCGGAGGAAGTAGTAAAAATAGCTTTGTACTT
ATCCCTCCGTTGTATAAAATATCCAATCCTTACCATGTACTTCCTCCGTAAAGTCGTT
TTGAACAACGATACGGTCTCCAAAATACAACTTTGATTTCTTGTTTCTATAAAAATAT
CTATTAAAAGTAATATATGTATACTTTTATGAAAATATTTTTCAAGACAAATCTATT
CATATATAATTTTTACATTTTCAAACTCAACAACTTAAGAGTTATTCATGATTTATATTC
CTAAGATTTGACTTAAAAACAGTCCTAAACGACTTCCTTTACAAGCACAGAGGGAGT
ACCCGGATATATACGTGTCTAGTTACGTGGCTAGAAATTGTCTCTCTCTTTTCTTTT
TTTTCTTTTTTGATATAGTAGTATATCGGATACAGCTAGAAGTAACTATAGTGTTAGC
CTTTTTTAGCGAATAAAGGTAGAAGCTAATCTTTAACCACGTTCTGGTAGGATGACA
GCTCTAATTTTATTTCACATCTTTTAGATGTGGATGTTTTCAGCGTGTAATATATATC
TCCTTTTTCAAAAAAAAAACCTATATTTTAAACGAACTTATATAGGAATTTTCAGTG
GTAGACTGAATAAGTGTTTGACTTGCTGGTAGAACGACTGGATATTTGCACACACG
AATAATCTTACAGTCGCTTGGCGCAACAGCCAACCTAGCTTGAGGCTCAAATTAAAG
TCAGAGCACGAGCCTGACCAACGCCGGCCGGCGGCGGGTCTTCTCCGGCGCCGGCG
GCCGGTGATCGATTTCATTTCCAGGCTTATTCTCCGCGTATGCATGATGTGTCAAGCT
ACTGAGCTATAGCTAGCCGTCTCTCGTGTACGAGTCTCTTACCACTCTTGGCTAGC
AAATCTGACGACTCTTTGACTGAACGAACAACTCGTACGTCTTAAAAGCCAAGAAA
ACAACCCGGTAGGCTGTAGGTGTGTTCAAGGGGTATTTTGATTTGGTACCTATATA
TTCTTGTCTTTATCAATTAATTCGTTTGTAATAAATTGTACTTACATGTTAACTATTTG
AATTAGACCTAAAGTATACCAAATCAATAGAGTGGTGTCAAACAGGCACTACCAAA
TAAAAAAAATGCCTACTAGCAATTTTTATTAGGGTTTGAAACCATACAAATCCTAAG
TTATCTTTGTGATACTATTGTCGTCGGCCTCACCCATGGTTTGCATATGGTTGAATAT
ATCTGGGATTTTTTTCACTTAAACGGACATCTCCTTGTTATTATTTTAAAAAAAAATT
GACAATAAAGAATATTATGTAATATTTCAATCTAAAAATATATAAGTTTAAATTTAA
CTTTTAAAATATATTAAAAATAATAAATATTATTTTGAATGTCTGTATACTAGCTATA
GTTTAATTTGTTTTTTTAATAACTTGTGGAAGTTAAACTTAGCATTATTCGTGTGCGA
AGTGATATATATCATATTAATTTATTTTATAGAAAAGAATTTTTTTATAACTGTTTG
AGTGGCCTAAGAAAAATAATGGAACATCCTCTCGAGGAATAAAAATTCATCTCCAA
TATATTTACTGTGTTGATCTTTCGCTGGTGTGTTATAGTGTGCGTCCGTCTTCTTTTTT

-continued

| SEQUENCES |
|---|
| TGCCTTGTCAACCTATTACGTACTGTCATGTATGTTAACGGACTTGTTAGGGAAGCA |
| AACTGTGAGTATGTCTTGTTTATTTTTCTTGGTTTTCTACCTAACTATTACTATCATGT |
| ATGTTAGTGTACTTGTTAGGGAAGCAACCATGAGTTAGGAGACATACGTAATTTGTT |
| GGACTGTTGGGTGTGTGGTGTATTTTTGTGGCTAGAGTTAATTTGGATTTTTATTA |
| TTTTAGTTCTTTAAAAAAATTAAAATTTCTCATTGATTTTTTTGGCATTAAGATAATT |
| TTATAAAACCATGAAAATAGTGAATTCATTCATCTGTCTATTACCATGTTTTAACGAT |
| TGGAGAGCACATATTAACATGAATGCATTTTGCACTTAGTACCTCCATTGTTTTTTTT |
| TTGGGATCGAAATACATCACGTAATAACACCTAGGAACGTACGCAACATCATTTTCA |
| ACTTTTAAGACCCCTTTCTCCAATAATTGAAAAATTAAACATGAACCAACCTATTGA |
| ACTTCTATGTATGTCACCATCATCGCATCTCCCTTTTAACCTACTCCCTATGTTTCAC |
| ATTATAAATTGTTTTCGGCTAGTCAAAATTATTCTAATCTAATTAAGTTTATAGGATA |
| AAACGTAAAAGCATTTTAAAACAAAGCAAACATATAAAAATATAGTAAATGATAG |
| ATTTAATGAAAACAAATTTTGTATTATAAATGTTGCTAATTTTTTATAAACTTGACT |
| AAATGTTAAAAAGTTTGACTTAAGATAAACTCTAAATGGCTTATGATGTGAAACCTG |
| GATAGTAAGTCCATATAGATAGGCTCTGGCCATATTGGTGCATGTCACCCTCCAAAG |
| TAAAATCTTCATTTATCTGGCCCCAACGGCCGCTCAATACTTTAGACCAACCAAATC |
| ATTTCCTTCCATCTCACGGTAACAAAATGAATGATGTTTTATTGTCTCTTCATCTTT |
| GCACATTAAAAAAGTGAAAACTTTATAACATCATTACTGGTAAGCATTACGCAACAT |
| GGCACTGACTTCTTGTCTGAATGTACACAAGCAACAGCTTGTTTTTATAGGACAAAA |
| TGACAACATATTGCCCTGTTGGAACTTAGATGTACATTTGTCATGTAAGGATAATAT |
| TAAAATGAAATCTGTTGATAGGAAAAGTGAAATTTTCTTTCTACCACTACCTAATAT |
| GTGGTCCTACCTATGTATACGTAAGATTGGCACAAGTAAATTTGGTATGGAAAATTG |
| TATTATTATACTTTTATTAATCCCTCCGGTTTTTTAGTACGACGTCATGAATGTTGG |
| ATACATGCTTGAACATTTATCTTATTTAAAAAATTAGTCAATTATTATTTGTGATATT |
| GTGATTTATTTTATCACTAAATGTATCTTGAGCATAATATTTAATTCTTTTTTATATTT |
| GCACAAATTTTTGAATAAATTGAACAATCAAATAGTTAAATGTATTTCCAAAAGTAC |
| CATATACTAGTTATGTTTTTTAATAGGTAATGCCGTTGACTTTCAGACACACATTTGA |
| CCATTCATCTTATATTAAATAATATATATAATAATTATCATTTATTTTGTTATGAGTT |
| ATTTTATCAGTAAAAGTACTTTAAGCATGATTTGGAACTTATGCATTTGCACAAAAC |
| TTTAAAAGTAAAACGGATGATCAAATACGTGTCTAAAATTCAATAGTGTCATCTATT |
| AAAAACAAAAATAGTATTAAAAACAGTGGTGGAGCCACCGCTGGGATCATCGCAG |
| CGAACACACTGTAAAATTTGATATATTATAGAATTGAAAACAAAATTTTCATAGCAA |
| ATACTTGTTGTAGTTAGATTTACCCGAGCATCGTAAATTTTCTAGTCTCTGCCACTGA |
| TTAGAAATGGAGGGAATAATAAGTAAACAACAAGTAGTGTGAGTAATAAGCAAAG |
| GTGATGACGTGGCATGCAGGACGTGATGTTCGGGGGACGGAGACGGTGGCGTCGG |
| CGATCGAGTGGGCGATGGCGGAGATGATGCACAGCCCCGACGACCTCCGCCGCGTG |
| CAGGAGGAGCTCGCCGCCGTGGTGGGCCTCGGCCGGGACGTCGCCGAGTCCGACCT |
| CGACAAGCTCCCCTTCCTCCGCTGCGTCATCAAGGAGACGCTCCGCCTCCACCCGCC |
| CATCCCCATCCTCCTCCACGAGACCGCCGCCGACTGCCTCGTCGCCGGCTACTCCGT |
| CCCCAGGGGCTCCCGCGTCATGGTCAACGTGTGGGCCATCGCCCGCGACCGCGCCG |
| CCTGGGGCCCCGACGCCGACGCGTTCCGCCCCTCGCGGTTCGCCGCCGGCGCCGCCG |
| CCGAGGGGCTCGACTTCAGGGGCGGCTGCTTCGAGTTCCTCCCCTTCGGCTCCGGCC |
| GCCGCTCGTGCCCGGGCATGGCGCTGGGGCTCTACGCGCTCGAGCTCGCCGTCGCGC |
| GGCTCGCCCACGGCTTCAACTGGTCGCTCCCCGACGGGATGAAGCCGTCCGAGCTCG |
| ACATGTCCGACATCTTCGGCCTCACCGCGCCGCGCGCCACCCGCCTCTCCGCCGTCG |
| CCACGCCCCGGCTCACCTGCCCCTTGTACTGACGGCGGCCGGCGACCGCGGCGGCGT |
| ACGGCAAGAATGGTTTGCAGGTGATGGTGTTAAAAGTTCAGACGCGTGTGGCGCCA |
| TTGGAGGAGCTTGGTGTGGCTAGCTTAGCTTCCTCTGGGCCTTTTTTTTTTGCTGGT |
| TTAATTTTCTTTTTTTTTTCTCCTTTGTAATTTAATCCATGTCTCCAGAACAATAAGTG |
| GATTAGTAGGGTATAATTAAGGGTGACAGTGTGATATATAGACTATAAGATCAAAG |
| TTGTAAATTTGGTGTCCGGTGTGCCTGTCCACATAAGCACAGCCTCTGAATTTTCTTG |
| TAAAACTTTGTCATGAAAATTGAGAAAGAAAACACCTCGCTTTCCACGCGTACGCTT |
| ACCAAACTATTAAATGGTGTGTTTTTTAAAAAAAAATTCTATGGAAAAGTTGCTTC |
| AAAAATAATATTAATTCATTTTTAAAATTTAAAATAGTTAATACTCACCTAATCATA |
| CGCGCTAATGACATACCTCGTTTTGTGTATCTTTTTTTTTCCTCTCCTCTCAAACTATC |
| GGGTTGCTATATGTTATTAAAACGGGAAAAAAAAGGCAAACTCCGAATGTTTGTTGT |
| GAATTTACATTTCTACTAAAAATTTAGGACCGCATGAGTTGTGATGTAGTGGCCTGA |
| GATGTGAATGGGGAGAGATCGTACAGGGCCAAATATTTCCCCAGCGGCTGTACAGA |
| AAGACCACCTATACAACTTTTCTCAATGTAGTAATATTATACTCCCTCCGTTTCTAAA |
| TATTTAACACCATTAACTTTTTAGCACATGTTTAACCGTTCGTCTTATTTAAAAATTT |
| TTTGTGAAATATGTAAAACTATATGTATACATATGAGTATATACTTATATTTAACAAT |
| AAATCAAATGATATGAAAATAATTAATAATTACTTAAATTTTTTAATAAGATGAACG |
| GTCAAACATATTTAAAAGGTCAACGGCGTTAAATATGTAGAAACGGAGAGAGTAAT |
| TTTCTTAGGCATCCTACCAGCATTAGTAGTTAGAGCACCCGCAATGGTAAAGTAAGG |
| TGCTATCTATAAATATGTACATCTCAGCAATAGACTAAATTAATAGTAAAACACCT |
| CAATAGTATGTCTACATAGGTATCTATAGCTCTCTAATCAATTGACTCATTTTTCTCT |
| ATAGACTATCTCTAAGTTAGTAGATAGTTTTACTCTCTCTTTTCATTTAATCTCTTTCA |
| AGTAGGAAAATATGCTGACATAGGGAGCCTATAGATAATCATTGCGGGTGCCCTTA |
| GTACACCTGTAGTCTAGTCACACAGTTGCATTAATGAGTAGTTTATAATAGCCATAA |
| TTAGGTTACTTGTAACCAACAGTACTGATGACGAACATATATATATATATATATATA |
| TATATATATATCTGTTTTTGTTTGGTGAAACGGCCTTTTCTTGTGTAAGATTAATTCA |
| AAATTAGATGGCGCAGGAGCAGGAGCAGAATTCGTTCAACGAATTCACTGTTCAGC |
| AACGTCGGCCAGATCAGAAAACGACCCTGCAGAACAGCAGAAGTGGAGCTTTCTTA |
| ATTACAATCTTCAGGCATCGAGGTAGCTACCCGACCCTCTAGTTTCATTTAGCTCTTC |
| AGAGTTAACATTCATCATGCATGGAGTTGGTTGCTAGTGATTACTCCATCTGGTCAC |
| AATCAAAAAAAAACATGTTGTCTTCGGCATTTCTTCTTCCAGTCAAGAGAGAACATA |
| ATATTGTTGGTGCATCAAATTTAAAATGGAAGACAAAGCTATCAACCATAATGACCG |

| SEQUENCES |
|---|
| GTTGTTAGCTTAATAAGGAGTGACGAATACTTGAAAGCTGGCTAATTCAGAACCTTC<br>TTTCTAGGTCGGCCGAAGGATTAGGCTAACCTAATTATATTAAGATTGAGAAGTTTA<br>ATTTACAGATACTTTTTTAATCCTTGAAAGAAAATCAAAGTGTGATAAATATGATTT<br>TTTTAAAAAAAAAACAATCACCCTCTTTTCTCCAAATTATCTGCGGTAAGGCATGTC<br>CACTTTGTGGCCACCCTCCAATGCCGAACCTTTGCTGAATCTCAAGCAAAAGGAACA<br>AGCAAGAAATCTCTGCTGGAAAGGGAGGTTGATAAAAGGCACTACTCCACAAATGT<br>CAGTTTTTTTGTCTGAGCTTGGTATTATTTATTTAAAAGTAGCTAAATTTGTAAGTTG<br>GTTACAATTGTGCAATAATAGTAATAACTTGCAACGTCCGAGCTAATTTACAATTAT<br>GGGTGACCATGTTTCGCATCACTAAGGCTGTGTTTAGTCCATACCAAAATTGAAAGT<br>TTGGTTAAACTTGGAACGATGTGACGAAAAAGTTGAAAGTTTGTGTGTAGGAAAGTT<br>TTG |

SEQ ID No: 100
>Maize_A0A0B4J2X1
TGTTATTTTGCATCACTATTTTTAACCAATTTTTAAGTTACCGTACCAATGC
ACGGGCACCCATCTAGTATAATATATAGAAACCATAACGACAAAAGGGCAACTAAC
TAGTACACAATAAATTCCATGGGAAAATTTTGACGTTGGAGGAAAACCTACTAGTGT
TCTACCATCTACCGAGTCCATATCTTGGGTGCTCTGCCAGATCCATATTTTGCTACAA
TTATTATCCTTCTTAATATCAGGCACTTCAGTGTTACTACTCCATCACTTCTCATCGTC
AGGGAAGGGATACCATAACCTAATTTCGAATGCAAATATAATATAATTAAATGTAG
AAAACGAGATCATATTCCTATCACCAGTTATCTCAACCTAATATTTAATTCTTCCAAA
TGAACCTTTGATCCATCTAGATCATGAAACATAAGTTACATAAAAATCCAACAAGAT
ACACCGATCTCATACACAAATCTAACTGGTGGGAATAAATAGCCAAAACAATTTG
TATAGTTGGCTTTTTTAATAGTACAGTAGTACATCCAACAATCACTACAAGTAACTG
TTCTTTTGGAATTATGCAGTCAACACGTATGGAATTTGACTATCAACATCTCTAAGA
ATATTAATTTCAAATGATATTTTGAAAATGGTATGGCTAGATTTTCATCAATATTAGG
TTCAACATATTATAAATTACAATACGTTTTAAACATACTCATACAAATTATTCATAGT
CCAAGTGTTTAGTTGGCTATAGAAAAACAATATTTTGTTTGTTTATACAAAAGAGTCA
GATTCTTTGAAATTAATATTTTTAAATCCATACTTATAAACCACCGGTTTTCACGGTT
CCACAGGCGTCATATGTCACCCTTTCCCTTCTTCTTTTATGCAAAAATAAGATAAATT
ATTCATAAGTGGGAGTTTGAATCCTGGTTGTTGGCTCCACATTAACACCATCCTAAT
CAATAAAACACACACTTTTGTGTTTTATTAAAATAAAATCTCTCTATGTGATACATA
GAAACCGTAGCAATGCAAGAACATCTAACTAGTTAATCCTTTATGCTTATTAGATTC
CACCTAGTGCATGCAACATTAGGTGCATAAAAACCCAAGAGAAGAAAATGTAGAAA
ACGGTAATAGTCTTCAATTCTGCCAAAAAAACTTACCTATCCAGTGCATGCAACATT
AGCTGCTTAAAAATCCAAGAAATATATGCTGACGCTCATATATAAATCCAGCTGGTT
GGAATAAATAGCTGGGAAAAAACAAGATGCATAGTTGGCTACTTAACAGTACAGC
AGTACTTCCAAAATCACAATAACTGTTGCTTTGGATGTATGCAGTCAACATATGTC
TTGATCTTGACCATCACTGTGTCGAGGAATATTATGTTCAAATGATGTTCTGAAAAT
AGTATGGCTAGATTTTCATCAAATTAATTTGAAATTTTCTTACACAAAATTAATCT
GTACTATTTTTTACTATCAGAACATATTTTTATGTTCTTTTGTTTAAGTATCTCGATTG
AAGCACCATCTCGCACCATTTTTAGGCATGAAAAATTCGTATGTCTTTTCTGTTTCTC
TTTTTTCTTTTACTATTTTGAATTTTCTATCATTTCAAACATACTGATGCAATTTTCA
TAGCCAAATATATAGTTCCTCCGTGATCATTTATCTGTTTGTTATAGGAAAGACCGA
AAGAGCAGCATTCCAAGAAATAAAAGTAAATAAATAGATCATTTTATTTGCTTAGA
AATCCCCTTTTCATTTTCAGGCTCTAGAAATCCATCCGTTAATTAATTTGCTCCATAG
TATTAATAAGAGATAGAGAGATGGGGAGGGAGATCCTTTTCGTAAAAGAGAAAGA
AGATCCTATTTCTATCACGCTATTAGATTATCTCCAGCAGTCTCTCTTATTCTATTGT
ATATTTTAAAATTTACTCTGTAAACCGTGTCTAGAGTTTAGAATGTAACATAGTATTT
TTGAACAGTATTAGACGGCACAACTATCTCAATTTCTCAGACCCAATATGGAAGTCC
AGGTCCTCACCTACTCCTCCGGCTATATATGAACCGTGCACTCCTCCCTTTCTTTTCA
GCTCTACTCGAAGAGCGTTCTACCACCACACCACAATCTAACTAAAACCCAAACGA
AATAAAAGGAAGAGGTCAAAAAATAAAAGGTGTTGTGCAATCGATCATGGTGACCG
TGGCCAAGATCGCCATGGAGTGGCTCCAAGACCCTCTGAGCTGGGTGTTCCTGGGCA
CGCTGGCCTTGGTGGTCCTGCAGCTGCGACGACGGGCAAAGCGCCGCTGCCGCCC
GGGCCGAAGCGCTGCCGATCGTGGGCAACATGGCGATGATGGACCAGCTGACCCA
CCGCGGGCTGGCGGCGCTGGCCGAGAGGTACGGCGGGCTGCTGCACCTCCGCCTGG
GCCGGCTGCACGCGTTCGCGGTGTCGACGCCCGAGTACGCGCGCGAGGTGCTGCAG
GCGCAGGACGGCGCGTTCTCGAACCGGCCGGCCACTATCGCCATCGCGTACCTGAC
GTACGACCGCGCCGACATGGCGTTCGCGCACTACGGGCCCTTCTGGCGCCAGATGC
GCAAGCTGTGCGTGATGAAGCTGTTCAGCCGGCGCCGCGCCGAGCGTGGGTGGCC
GTGCGCGACGAGTGCGCGGCGCTGGTCCGCGCCGTGGCGTCCGGCGGCGGCGCGG
CGGCGAGGCCGTGAACCTGGGCGAGCTCATCTTCAACCTGACCAAGAACGTGACGT
TCCGCGCCGCCTTCGGCACCCGCGACGGCGAGGACCAGGAGGAGTTCATCGCCATC
CTGCAGGAGTTCTCGAAGCTGTTCGGCGCCTTCAACGTCGTCGACTTCCTGCCGTGG
CTGAGCTGGATGGACCTGCAGGGCATCAACCGCCGCCTCCGCCGCCACGATCCGC
GCTGGACCGGTTCATCGACAAGATCATCGACGAGCACGTGAGGCGGGGAAGAACC
CCGACGACGCCGACGCCGACATGGTCGACGACATGCTCGCCTTCTTCGCCGAGGCC
AAGCCGCCCAAGAAGGGGCCCGCCGCCGCCGCGGACGGTGACGACCTGCACAACAC
CCTCCGGCTCACGCGCGACAATATCAAGGCTATCATCATGGTACGTACACACGTCAT
CCTCTGACCTCCCTGTTGTCACGCTAATCACGCCAAAATCGTCCGTTACGTTCCTCGA
CTCGTTTTTGCGCTTAGGAAAATCGTGATGTGCCAGAGCAATGAACAGTAGCAACAT
GCATCGACGAAAGAATTTGAAATGATAGGATTCGATATATATATCCTGACTGAGA
TATATATAGAGCATCTCACTTCTCGTGTGTCAGGATATATAGGTGTGATTTAATTCTA
TTATTACTAACTGCTATGAATGGTAGTATTACGGAATCAGACGTGCTTTCTGCTGGT
GACAGACTGAGTAGGTGTTGTCTTGTTCCTGCATATGTGCGTAGGTGCTGAACGTCC
ATATGTATTCACGAGCTCAAAGTCAAACCACACATAGTATACTACGCCTTGTCTTTC -continued

| SEQUENCES |
|---|
| ATTCAGTATACTAATTGTCCATATGTATTCACGAGCTAGCTACGTAAGTACCGCCAC |
| GATCGACGTGTATATAACATACGTATCCTTTTGCGATGATATTTTTCTGTATATATAC |
| GGCTATATTAATTGTCCGCCCTGTAGTTTGCACATCCAGCGAGTCCAAACTAATCCG |
| GCCAGCCAATCTCTGGTTTAAATACATAGATATGTCGTAATCGTAATAGAATGCGTG |
| CATGTAGTCGACCTTCCGTCATGGACACAACTGGCATGTCTCTGACGAATGTGGCGT |
| GGTACAGACGGCGCTCCCTACAACTTTTGTAGTATGTATATCTCATTGCATTGTCACT |
| AAGATCTTATTATTATTATTTATTCTTGATGAATGGTCAAAGCTGCAAATTAAAAAA |
| AATCATAGTAGCAAAGTGCAGGTACATTGATATGGTTTCCATTTATAAGTATAGAGT |
| ATAAAACATAATGATATATGTGTTACGTGGATTTGGAGCTCACAACCAAAGTTCAAA |
| TCCCACTTGTACAATAATTTTAGATTTTTATAGATATCGACAGCGTCAGCGTGCATCA |
| TCGTCCTGTATCATGCATCCAGAATAAATGATACATGTGTTATGTTGGTTAGTTAGTT |
| GAGTATAAATGTGGATTTGGAGCTCACAACCATATAGTTCAAATCTCACTTGTACGA |
| TAATTTTAGATTTTTTTTTATTTAAATATGTGGGAACACCACGACCGTTCATAGATAT |
| TGACAGCGTCAGAGTGCATCATCGTCCTGTATCATGCATCCAGAACAAATGTTTTAT |
| TTCTCTGTTAGTTGTTGCTGGATCGAACTATGGGCCTGTTTGTTTTGGCTTCTGGCAG |
| CTTCTGGCCACCAAAAGCTGTTGCGGACTGCCAAGCGCTCAGCTTTTCAGCCAGCTT |
| CTATAAAATTCGTTGGAGCAAAAACCATCCAAATCAACATAAACACATAATCGGT |
| TGAGTCGTTGTAATAGTAGGAATCCGTCACTTTCTAGATCATGAGCCCTATAAACAA |
| CTTTATCTTCCTCCACACGTAATCGTAATGATACTCAGATTCTCCCCACAGCCAGATT |
| CTCAGAAAAGCTGGTCAAAAAAGCTAAACCAAACAGCCCCTATAAATGATGCGTCT |
| CTATCTTTTGGTCGTTGATGGACGACGCGTGCGCAGGACGTGATGTTTGGCGGGACG |
| GAGACGGTGGCGTCGGCGATCGAGTGGGCGATGGCGGAGATGATGCACAGCCCCGA |
| CGACCTGCGCCGGCTGCAGCAGGAGCTCGCCGACGTCGTGGGCCTGGACCGGAACG |
| TGAACGAGTCGGACCTGGACAAGCTCCCCTTCCTCAAGTGCGTCATCAAGGAGACG |
| CTCCGGCTGCACCCGCCGATCCCGCTGCTCCTGCACGAGACCGCCGGCGACTGCGTC |
| GTGGGCGGCTACTCCGTGCCCAGGGGCTCCCGCGTCATGGTCAACGTGTGGGCCATC |
| GGCCGCCACCGCGCCTCGTGGAAGGACGCCGACGCGTTCCGGCCGTCGCGCTTCAC |
| GCCCGAGGGCGAGGCCGCGGGGCTCGACTTCAAGGGCGGCTGCTTCGAGTTCCTGC |
| CCTTCGGCTCCGGCCGCCGCTCGTGCCCCGGCACGGCGCTGGGCCTGTACGCGCTGG |
| AGCTCGCCGTCGCCCAGCTCGCGCACGGCTTCAACTGGTCGCTGCCCGACGGCATGA |
| AGCCCTCGGAGCTGGACATGGGCGACGTCTTCGGCCTCACCGCGCCGCGCGCCACG |
| AGGCTCTACGCCGTGCCTACGCCCCGGCTCAACTGCCCCTTGTACTGACGCCATGCG |
| CGGGCGACTGCCATTACCATCGTCCCCTCGGGTGGGTGTGGGGTACGGGGGTAGGA |
| GTTTGGTGCCTTTCTCTGTCGTCTTTTTTCCCTTTAAAAAACATGCCTGGTCGATGTTG |
| TAGGGTGTGTTGTAGACAGCCATTATCAATTTTTTTTATTCTCAATTCTCATGTTGCG |
| TGTGCCTAGCTAGGAAGTAAAAGGATCAAGCTGTGGCTGTACGGGCTCATCAAACT |
| ATATGAAAAAAACATGTCAGCCACAGATTCCTGGAACTTTCATGCACGGCAAATTTC |
| ATAGATATTTCTTTGGCACCTCTTATCTATCGTGTATCCCATATATATTAATCTCTGT |
| ATTAACAAAATTGGAGCTTCCTCACGTACGCACCCAGGCACTGCTCACCACCGTTTA |
| AGATACAGCTCAATAATGTTCCTGCACTGTTTAATATTGTATTGTATATCATTGTTGC |
| CCGCGCTAAATATATGTTTACTGTTTGGCAACATATCTAGTGCACATGGACTGCTGG |
| TGCACATCATACATATATTAAATCCTACCCTTTCATCTAAGATCAAGCGTCTCACAAT |
| TATCTCACCTCTCTCTCTCCTGCCTTTTTGCTAAAATGCCCTCCCGCCTCTCCCACT |
| TCCTACCATGTCGTTTTTAGAAAGCTGCATGGCGGACTGTTTATCTGCTTGATCAGA |
| ACGGCTGGGAGTATGCAGGATTCAGCCGTGCCAGATTTTTTTGCTTCCTCCGGTCAA |
| TAGAATATGAATGTATGGTGTAGATGAATATATAGTGGCGTTTTCATGCACCAACAG |
| AATGAACGAACAAGATCAATGAGCAAAGAAACTGACTACATCTAGTACATATATCC |
| CCTATTGTTCTCTCTCCATCTTTCTCTGTCTCTCAAATAAAATATGAGATATCAATAA |
| AAAACTAAATATGCTCTAACTTTTTGACCAATGATTTGAAGCCGCAGCTCAAAAACA |
| AAAAATAATATGCAATAGATCAGTAAATCTTTCATTGCACCATTTTCGATCACCATA |
| CCTATGTACCACAGTCTTGTATATGATGACATTGTAAGATACATGTCATCCAACAAA |
| GAGACCGTTGATTCTAAATCGCCCTGGACAGAAAATCCATAAATTAGAATTACAAA |
| ATTAACAACATACGAAGGTCATCCGTGGTGATCGTGACGGCGCCAAGTGATGGTGA |
| TCGAGCCTTTGTAGGCTCCCTCTTTGGCGAGTGTCTGCTGGACTAGTGGTCGACAAA |
| GAAGGCTCCCGTGGCCCCCTTTGCTAGTCTCTTTGTCGAGTGCTCCAAGAGGCACTC |
| GGCAAAGTCTCTCTTTGCCGAGTGCTTACTCGACTAACGGTCGGCAAAGGGAGCA |
| CCAGTGGGCCCCTTTACCAGGCCCTTTGTCGAGTGCTCCAGGAGGCACTCGACAAAG |
| ATTGTTTTTTGTCAAGTGTAACACTCGACAAAGTGACTAGAATATCTCATTTTATTT |
| GTTTTTATTATTCCATCCAAACAAACAAAAGATATATCACGAAATTATCACATATAT |
| ATCATAGATATCACAAAAATCATCGCATACATCGTACACGCCACATATCTCACAAAG |
| ACCACAAATCTCACAAATATCACCTATATCANNNNNNNNNNNNNNNNNNNNNNNNN |
| NNNNNNNNNNNNNNNNNNNNNNNNNNNNNNNNNNNNNNNNNNNNNNNNNNNNNNN |
| NNNNNNNNNNNNNNNNNNNNNCAGGTATTAGATATTTCGTCACAAGTTTCAGACAC |
| AAACATAAGTCTCCATCACTCACAAACATTTGTCTCAAGTATCTCACAAATTATTAC |
| CAATGACAACAAGTTCAGACCAAGTTATCTCATAAAGTATTAACAACACCAATAGA |
| CATAAGATCGTGTGCACAAAGTATCTCGGCAAGGTGGAGGGCTGGACTGATTCGGC |
| GATAGGTTGGACGATCCATGAGGGTTGTTTGATGCCAACGTTTGTCCCTATACAGAG |
| AAGAGATTGCATGTGTGAGACCAGATAAATATATATCATGCAGGGCTGGAACTTTG |
| ATACTCACATAAGTATATAACTGAGTAGGGTTAGCTTGAGGGAACAACGAGGTGGT |
| GGAACAAACCATGTGCGGCACCAAGGCTCTGCATGTACTGAAACATCTTCGTCATT |
| CTTGATCCGCCAAGCGAGCTGCCTGCTCCGCCTCCCACTCCGCCCTCATCCTCGCCTC |
| CATCTCCATCTGTTCCCTCCTCTCTTCTTTTAGCTAGGCCTGTAATATTTCACCCAATG |
| TTATAATAATGCAAAGAGAAGGTAT |

SEQUENCES

SEQ ID No: 101
>Maize_B4FWF9
TAAAAAAAACCGCCAGTGGAAATAGCATTTCCACTGACGGTTTTCTTAAT
AAAACCGCCAGTGGAAATGCTATTTCCAGTGGAAATGGCGATTTTACTGGCGGTTTT
AGAATAACCGCCAGTGGAAATGGCGATTTCCACTGGCGGCACTGAAAAACGCCAGT
GCAAACAGCTCTAGAACCGCCACTATAGAGCCTCTGTGTACTAGTGTTAAAGTAAAA
TCCATAATTTTGTAGGATCAATATCCTTGTTCCCATAGTCAATTGTGGGAGTACTCCT
TGTCTCCTACTCAATCCACTAGTAGAAAAAGGCTTAACACCTGCGGGACGATATATT
TTTACAGACGGATCCGGTTATCCACCGACTGTGCTATTTCTAGTGGCGGTTTTCTTAA
GGAACCACCACTAGAAATCATTTTTATCCTTAATTTTTCGAATTTTTCAAACGACCTC
GTATGACAAAACCACCAAAATAAAAGTTGTAGATCTCTAGAAGTTATGAAACTTTGT
AGTTGACAACTTTTTTATTTGAACTTATTTCGGTTCTCAAAAATTGAATCTAAGTATG
TCAAATTTAAAATTCAAATTTTGCAAACTACCTCGGATGAAAAAAGTGTCAAAATAA
AAGTTGTAGAACTTCAAAAGTTATTTATCTTTGTAGTTGACAACTTTTTTATTTGAAT
TCGTTTAGGGTCTCAAATAAGCAATTTACACTCAAATGGTTGTAATATGTGGAGAAA
ACAACTACAAACTAGACACAAAGCATGTCATAGACGGAGTGGTAGTGGAGGGTACG
CGCGAGGTCGACGGGTCAATTACTAACAACCGCGTAGCGCGCGAAAAATGCCGTGA
CTTGCGACTTCGGAGACGGGCGGGTGGGGTGGGCCTAATAAAAATAAATTTTTTTAC
TATTTTTAAAATCTGTTTTATGTTTTCTGGAAACGATTTGCACTGGCGGTATTATTAC
GTCGATCGCCAGTGAAAATCGATTTTCACTGGCGGTTTTATTATGTCGACCGCCAGT
GAAAATCGATTTTCCCGCCTGTAAAAATGATGATTTTTACTAGCCCCCTAGCACTGA
CGGTTACGATAAACGCCACTAAAAATAGGTTTACGACCGTCAGTATAGATCTTCTCT
ATACTAGTGATATCCCTTTCTCATGTAACTCCATTTCAAATGAAAATAAAGAACAAG
TAGAAAAAAAATGAAAGAGACCCAATTCTTGTCACCATTATTAGGCACAGTTAAC
TGATCGAGTTTTCAACCCAATGTATCCCTGGGTCCTCACCTAGAGATGGCAATGGGT
ACCCGCGACCCGATACCTGATGGGTATTTACTCCATTAGGGTATGTATGTGGGCTAA
ATATTCTACCCGTGGGTCTGTTATTGGGCAAAAATCTTCACCCAATGGGTAAACGGG
TATTAGAACGTTCCGCCTTCACCCATACCCGTTAACCCGTGGGTATAAAATACCCAA
TATAAACTTATCCGAAGCATGAACTTGGACTTTAGTCATCCAACTTTTTTACTATTTA
ATAACAATTTAATGACCATGTAATGGAACATGTAATGTGCTATGTAGTACTATCATA
GTGTTACTACTTTATCCAATTATCTTTGGTGTGTTGAATGGATGGTTAAATGATGCTA
GAAAATTTTGTAATGGTATTTATATGGATATACTTGCCATTTGTATAGTATAATTTTT
TGATAGTTGTTTAATTTTTGTGGGTACGGGTGACCCGATGGGTGACCCATACCCACA
TGGGTATGGGTATGGGGTAAATCTATACCCGCCAGTGTATATGGGTGACCCGGTGG
GGTTATTTTTGTGTCGTGGGTATGGGTATGGGGTAGTAATACCCGGTGGGTATTTAC
CCATTGCCATCTCTATCCTCACCTACTCCTCCGGCTATATATAAAAACCGTGCACCTC
CCCCCTTGTCCTCAGCTCTACTCAAAGAGCGCTCTACCAGTACAACTACAACCACAC
TAAAACCCAAACAAAAAAAAGGAAGCAGGTGCTGCCGATATATCGATTGATCGATC
ATGGCGGCGGCCGTGGCCAATATCGGCATGGAGTGGCTCCAAGACCCTCTGAGCTG
GGTGTTCCTGGGCACGGTGTGCTTGGTGGTCCTGCAGCAGCTGCGACGTCGGCGGG
CAAAGCGCCGCTTCCGCCTGGGCCGAAGCCGCTGCCGATCGTAGGCAACATGGGGA
TGATGGACCAGCTGACGCACCGCGGGCTGGCGGCGCTGGCGGAGACGTACGGCGGG
CTGCTGCACCTCCGGCTGGGGCGGCTGCACGCGTTCGCGGTGTCGACGCCCGAGTAC
GCGCGCGAGGTGCTGCAGGCGCAGGACGGCGCGTTCTCGAACCGGCCTGCGACCGC
GGCCATCGCGTACCTGACGTACGACCGCGCGGACATGGCGTTCGCGCACTACGGGC
CCTTCTGGCGGCAGATGCGCAAGCTGTGCGTGATGAAGCTGTTCAGCCGGCGGCGC
GCCGAGACGTGGGCGGCCGTGCGCGACGAGTGCGCGGCGCTGGTCCGGGCCGTGGC
CGTGGGCGGCGGGAGCGGGGGCGAGGCCGTGAACCTGGGCGAGCTCATCTTCAGCC
TGACGAAGAACGTGACGTTCCGCGCGGCGTTCGGCACCCGCGACGGCGAGGGCCAG
GAGGAGTTCATCGCCATCCTGCAGGAGTTCTCCAAGCTGTTCGGCGCCTTCAACGTG
GGCGACTTCCTACCGTGGCTGGGCTGGATGGACCTGCAGGGCATCAACCGGCGCCT
GCGCGCCGCCCGCTCCGCGCTGGACCGGTTCATCGACAAGATCATCGACGAGCACG
TGAGGCGCGGGAAGAGCCCCGACGACGCCGACGCCGACATGGTCGACGACATGCTC
GCGTTCTTCGTCGAGGCCACGCCCGGCAAGGCGACGGGCGCCGCCGCCGCTGCTGA
CGGCGGCGACGACCTGCACAACACCCTCCGGCTCACGCGCGACAACATCAAGGCCA
TCATCATGGTACGTACGTTACGTATACACACACGTCGTCGTGCACCATCCCTCGA
TCTGACCTGCTGTCAGTCACGCTAATACGCCAAAACCGTCCGTTCCGAGTTCCGAC
GCCGGGAGGACTGGGTGCCGGCCGGGGTTCGGGCCTCGGGAGCACTGAATCAAAAC
GCTTGGCTGAAGAAACCCGTAAACAAAAATACTTACTATATATATACCTAAAATGTG
TGACGACGTGTGATGTTTGACAACCAACCAATCAGGAGTGCTTTGCGTCTCTGCATG
CTGGTGACAGGTGTTTGTCGTGTTCCTGCATGCACGCAGCACATGTGGATCTCTTCG
CCCGCCACGGAGCTAGATTAAGTCAGGGCCACGTGTGCGTAACTCGATCTCCAGTA
GTGCATTTTTTCTTCGGTTTGGAGTTCTCTTCTACCCCGGCCGGCTTCTACGTTGAC
AAGCTCCAACCGGCCGGCCGGCCGGCTTCCAGAAAAGCAGTACGTGAACGTGACGT
TCGGTAGGTGTACTTGTTATTTGTTTGTGTCGTCCTCCTTGGTGTCTGGAGATCGAGT
CGATTAGCCAGACAGACCAGACGTAGCGCGCACGGTCGGCTTGCTTGTGCATGGT
GAGACACGTTTTCTCTTTTTTGTTCATACATGCATGTAGTACTGTGCGCATTTAATTT
GTGGCCATGCTTATGAGTCGTCTCACACTAGTACTGTACGCATTTTTAATTTGTGCGT
TGGTGGATTTTTTTCTCCCCATATATCACGACACGACGCACAAACATTTGTCTATAG
TCCAACTTTGCGCGTGACGTAAGTCGGTCGGTCGTCGTACAAAGTTTGGACGGCCGG
ATACCCTGCATCGATCGTTCTCCACCCTATATACGGAGCTGAAAGTAGGTAAACGTG
ATGAAAGCATCCGAGTTTGATCGAGCTAGCCAACCATTGGAGACCATGCATGTCACT
TTTCGGTGCATTTTTTTCGTCTAAGATAGCTCTGTCCACCTTGGTGCCTCGGTGCGTG
CATGTCACCTTCCAAAGTATATAAAAAAACACATGCATCACCCATTTTCTGCAGTA
TATATATAACCGCGCTAGCTGCCGTAAATATCTTGCACAATTAAACCGTCATGATTT
CGCTTGTAATTAATAATCTAGCATTCTAGCTTCCGTCATGGGCACAACTAGCTAGCA

SEQUENCES

```
TGTGCATATATGACTGATATGATCATGTGTGGCGTGGTGTAATTAATATTCACTAAA
AACATCATAAATAAAGGGTAATATGTACCTCACCATCGCGTCGTTATGTATTTTGTT
GTTTTTTATGAGCAGTCAAAGCTGTAAACTAATAATGATGTATGGACGCCGCATGCA
GGACGTGATGTTCGGCGGGACGGAGACGGTGGCGTCGGCGATCGAGTGGGCCATGG
CGGAGATGATGCACAGCCCCGACGACCTGCGCCGGGTGCAGCAGGAGCTCGCCGAC
GTCGTGGGCCTCGACCGCAACGTGAGCGAGTCGGACCTGGACAGGCTCCCCTTCCTC
AGGTGCGTCATCAAGGAGACGCTCCGGCTGCACCCGCCCATCCCGCTGCTCCTCCAC
GAGACCGCCGACGACTGCGTCGTGGCCGGGTACTCCGTGCCCAGGGGCTCCCGCGT
CATGGTCAACGTCTGGGCCATCGGCCGCCACCGCGCCTCGTGGAAGGACGCCGACG
CGTTCCGCCCGTCGCGGTTCGCGGCGCCCGAGGGGGAGGCCGCGGGGCTCGACTTC
AAGGGCGGGTGCTTCGAGTTCCTGCCGTTCGGGTCGGGCCGCCGGTCCTGCCCCGGG
ATGGCGCTCGGCCTGTACGCGCTGGAGCTCGCCGTCGCCCAGCTCGCGCACGCCTTC
AACTGGTCGCTGCCCGACGGAATGAAGCCCTCGGAGATGGACATGGGCGACATCTT
CGGCCTTACCGCCGCGCGCCACGCGGCTCTACGCCGTGCCTACGCCCGGCTCAA
CTGCCCCTTGTACTGACGCCCTGCACGTGGCGCGCGGGGACTGCCCATTACGCATGCA
TGCGTTTGGACTTTGGTGTTCATCCCTGGGGTGGGGCCGCCGTGGGGGAAGTTAGGA
GTTTGGTGGCTTTCTAGCTCTGTCTTCTTGTATTCTGTTTATTATAAATTTTCCCAACC
CTTCCATGCCTGATCGATGTGCGGTAATAATTGTTAGAAAATGTGACATTTTGTATGT
AATCAATCTATGGGGTGCAATTGTTATCTCGTCAAAGGACACACCACTCGACTTGCA
CCCCTTCATGTATATATATACATACACGAACATCCCCTGCAATAAAGAAATCGCTGT
CACTTTCTTTCGAACTCCTTTCCACTGTTTTACAATATGTTATCAACATGTGCTCGCG
AGAAAATAGTGAGAAGAGAAAAATGCTCGCTGTTTTGGAGAAGAACGGAGGCCCG
GCCTCAAGATCGACGAGAAATATGCATCATATGATCAACTCAACGGAGGATGAATT
ATACATTGTGGACAGTTGTACCACAAACTCTATACTTAGAGAGATCAAATATTTTCA
GACTCTTAAAAATGAAGATGAAAAAGTTTTGACCATCGCTGGATGCGATGCGGTGA
TAGTTAGCTCTGGACAACTATTACCCTCTCCATGGGTACTAAAATTGTTATCGGAGA
TGCACTATTGTATCCTGATCCCACTCGTACCCTACTAAGTTTTAGAGATATGCTATAG
ATGGGTTCTATATTTAAACCCATGATGAAAATCAAGAAGAGTTTCTCTTTTTGACTA
AGCCGGACAGATATGGCAAACGCATATATGACAAAATTTTATTACTCACGTCTGGGT
TGTACTATACATTCATTAAGTACATTGCACATGTTGTTGCATATAAGGTGATTTTTCA
AAATTGGTTATCGAGGCATAGGGATTATGATAAAAATCACAGGCAATTCTATTGGTC
ATAATTTGTCCATAACAAATTTTCTTAAATCGAAAGATTTTATTTGCACTACATGTGC
AACTGGGAAATTGATTTTGAGACCATCACATCTCAAAATTAAAGTTGAACCGCTAAA
ATTCCTTGAAAGAATTTAAGTAAATATTTGTGGATCAATTACACCAACTTTCGGGCC
ATTCAGATACTTCATGGTATTGATTGACGCATCTACTCGATGGTCACATGTGTGTTTA
CTATCAACACGCAACCATACATTTATCAAGATAATGTCTCAAATTATCAAATTAAAG
GCAAATTTTCCTGAACATCAGATTCAAACAATCCGGATGGACAATGCCGCTGAATTT
ACATTTCAAGCATTCAATAATTATTGTATGGCACTGGATATTCAGATTCAACACTCG
GTACCATATGTCCATAACCAAATGGTTTGGATGAGTCACTAATCAAGAGGATTAAAC
TTATTGCAAGACCATTGTTAATGAATTGCAAATTGTCTTCGTCATGTTAGGGTCATGC
AGTTCTGCACGCTGTCGATCTTATCGAACTATGACCTACTGCATATTATGCTACTTCC
TCAATACAAATGGTACATGGAAAATCTCCAAGTATTTCCTATTTGTATAAATTTGGA
TGTCGTGTATACATTCCAATCTCACCACCTCAAAGAACAGTCATGGGCCCACACAGG
AAAGTGGGGATCTATATGGGATTTCAATCTCCATCGATCATAAAATATTTAGGACTC
TTGATAGGAGCCCTAAGGCAGCTAGGAGCCGTTGAAGCTCCATTTGGTAGCAAAAG
TTGCCTTCTGTACGTGGGCGCACCGGACATGAATAGTGCACGATCTCCTTCCTTATTT
AGTGAAGCCGACCGTTGCAGCCAGGGTCCTCTTGGCATACTGGACAGTCCGGTGCG
GCTTGTTGACCGTTGGCGCTGGCCACGTGTCGCCCACTGATTTCGCTGCCGACCATT
GGCACGGGCGCTGCTGGCTCACCGGACAGTCCGGTGCACACCGGACAGTCCGGTGA
ATTTTAGCCGCAGTGTCCCCAACAAATCCCGAGAGCAGCGAGTTCACCGACGTGCTC
CAGTCTGGGCACCGGACACTGTCCGGTGCGTACCGGAAAGTCCGGTGCACCCGTAG
GCTGGTGCAAGTCTGGCTTTTTCAGCCAAACTTCTTTTGCTCCTTTTTGACTTGACTT
AACTGAGTTCCTGGTGCTTAGACAAGCATGTTTAGCTCATAAAACATATGACTAAGT
GTCTAGAACTTACCTTCATACTTGATACATCTAGATTGCTTCATATACTTTTGCTCAA
CATCATGTCAGTTCTCACATAGTGTGTTGTGCATCTAATCATCAAAACAATATAGAA
ATGGTCCAAGGGCAC

SEQ ID No: 102
>Soybean_G3E7M3
ATGATCATTCACAATTAATCACATGACTAATTATGATAATTAATCACATTC
TTGGTATGTGAAATAAAATAGTATTCTTATTTTATGAGCAAGTTCCACATTCATAAA
ATAATACTCCATTTTTATATTAATTATATTCTTGGTGCTAGTAAAAAATATAATAATA
TTTCACTAAAATATTTATTTGATTAAATTAAATTCTCTAATTTAATTATCAAATAAAT
TATTTTCTTTTGTAAAGATTAGAACACTCGTTTATATGTAACCCCGTAGGTTTAATAC
TAAACTGGTAGTAAATTAATCATAATTAATTTACTAATTAAGGAAGACGTCTAGCAG
CAGTCCATTAAGTCCAAGCATGAAGTAACATCTTTTACCTTCAAGAACAATTGAAGA
ATAATGTAATATTTCATTTCATTGTTGTTTATAACTCAAGGTTAATTCTAAAGTATAA
TATTATTATCAAACTCTAATAAGATAATACATTTAATCAATGAATGACTTAAGAAAC
TCTTTTTTCTTTCATTCAATTGTCATGTCTAAGATCTTAATTCTATCATAGAGCTCAAA
CTTGTTACCTAGAGTTGGTGGATTCCTTCTTGATTAATAATTAATTCTATAAGTATTT
AATCATATCCAATATTCATTAAACTAGTGCCTTAAGACATTAAGTGTCTAAAATTTA
AATATAACAAATAATTTGTTAACTATTATGATAATCTCATGTCAAAGGAAACTATTA
TATTTCTTCTTGAGAACTTTCTATTGATATATTAAGATAATATTAACTATTAGGAATT
TTCAATTAAGTCATTTCAATGATGACATCCATATATATATCATCTATATATGCAATTT
AATAAATAATATTTATTAATTTTTATCTAATAAAGACTTTTACATATATATTAATTTA
TCTGAATTATTGATGTCTTATTCATAATAATCTTACGATTAAGAATAATTTATATTAA
AATTATAAAGGAATTATTTATCATTATCATAATCTTGATCATGATAACAAACCTCTA
```

SEQUENCES

```
ATTTTAATTTTGGACTTGTCAATTCTACTGGAATTTTTTTAAAAAAGATGAGTGCATT
GCAGTATGGCAGAAACCTTCTCACAATAGCTGCTATATTTTTGCATGTTAGCTAGTG
ATTTTAATAGTTAGTTTTGGGTGTTGGTAGTTTTCTAGTTGTAATTTTTGTGGATTCTT
TTTGTTGATATATTCCTTAAACATGATTTTAATAGCCTTATCTTTTAATAATTGTGCTG
TAAATGTACTTTAAAAAATTATATCTAAAACGGATCGATTAGAACTTTTTTCATTAA
ATTAATTTTTTAAAAAAATACATTCTAAGACAGTTTTTTTAAAAAAACCTTCTTAGA
AAGTCTATTTTTTAAGATAGTTTTTGGAAAAATCATCTTAAAATCTTCAAATTTTTTA
ATTTTTTTGTTTTAAAAAACACATTCTAAAATGGTTTTTTGAAAAAAATCGTCTTAGA
ATCCTTATTAATTTTTTTATTTTTTAAAAATGATTCTAAGACGATTCTTTTAAAAAC
CTTCTTAGAAGGATATTTTTTCTAAGATGATTTTTAATGGAACCGCCGTCGAAAGTC
AAGATTTTCGATGACATTCGCTTCGAAGACAATCTTGAGTCGTCTTTGAATGTAGTT
ATGAATCGTCGTGGAATGATGCTTTTGCAGTAGGTTACAAAATTATTTATCATATAA
TATTAAAATATATAATAAATATTTACTATATTTATTAAAATCTATTTATTATTTAAAT
ATACTTATTTGTTAAATATTTATAATATATCAAATATGATATAATACATAAGTATATT
TAATAATAAATATTTGCCTATAACATGAACACAGCAAATTAGAATATATTTTTC
TTTTTGTTAAGAACCAAATTAGAATTTAAGAAACTAAAATCATGCAAATATAAAAGT
TTGGAAACTAAAATTATATAATTAATGGTCCAGATTTTTGCAAATAGGTAATCCTGA
AGCTGCAAAGGCAGGAGATCAGATCCCTGTCTCCGTAGTATCTTATTATATTTAATA
TTTAATATATAATTAATTAGAACGTCCACGTTTAATAAGTATCTTGCAGGAAGAAGA
AACTGAAGTGTATATATAGGTCCCCATGACACTCCCCTCAACTCAGCAACAACAACA
CTTACTTGAAGTTGTGCTATTCAATCCCAAAGCCACAGAAATAATATTATTCAGATT
TTAGAGACTGAAAACATCATGGCCAACCTCGACCTCGACCCATTCCAGACAAGCAT
CTTAATCCTCGTCCCAATAGCACTCCTGGTGGCGTTACTATCTCGTACTCGTCGAAGA
GCACCCTACCCACCAGGCCCAAAGGGTTTACCAATCATAGGAAACATGTTAATGAT
GGAGCAGCTAACCCACCGCGGCCTCGCCAACCTGGCCAAACACTACGGCGGCATCT
TCCACCTCCGCATGGGGTTCCTCCACATGGTCGCCATCTCCGACCCCGTCGCCGCGC
GTCAGGTTCTCCAAGTCCAAGACAACATCTTCTCCAACCGCCCAGCCACCATCGCCA
TCAGCTACCTTACCTACGACCGCGCCGACATGGCTTTTGCCCACTACGGCCCCTTCT
GGCGCCAGATGCGGAAACTCTGCGTCATGAAGCTCTTCAGCCGCAAGCGCGCCGAG
TCCTGGCAGTCAGTCCGCGATGAGGTCGACGCCGCCGTTCGCGCCGTCGCTAGCAGC
GTCGGAAAGCCCGTCAACATTGGAGAATTAGTGTTTAACCTCACCAAGAACATCATC
TACCGCGCCGCGTTCGGGTCGAGTTCCCAAGAAGGCCAGGACGAGTTCATTAAAAT
ACTGCAGGAGTTCTCCAAGCTCTTTGGCGCGTTTAATATTGCGGATTTTATACCCTAT
CTCGGGTGCGTGGATCCACAAGGTTTGAACTCGAGACTCGCTAGGGCACGTGGCGC
GCTCGATAGCTTCATTGATAAGATCATCGATGAGCACGTGCATAAGATGAAGAATG
ATAAGAGCAGTGAAATTGTTGATGGAGAAACGGACATGGTGGATGAGTTGCTGGCG
TTCTACAGCGAGGAGGCGAAGTTGAACAATGAATCGGACGATTTGCAGAACTCTAT
CAGACTCACTAAGGATAACATCAAGGCTATCATTATGGTATGGATTCGTATTCAAAT
TAATATACTATCTTATTCTTATCAGCCACCTAATGAAATTGATAATTCGTGGCATGAA
AGTTTACGCATTTGACTATTTCATTAAGAGTTGTTAAGAACACGGTTTTCTCAAAAA
CCACGTAAGCACGTACAACGCCAATACCTCGATGATTGGATGTCTTTTGGAATCCTT
TCTAGTTTAATGAGATTTTTTTTAATTGAGAAATCTAATTTCTTACATGATTTTTTCAA
TGCAAGAAGAGAAGATTCAGATCAATAAGGTTTATGCATGATTATAGAAAAATTGG
ATGAATTTAAGCTTTTAAAAAGTTTATGTATTTTTTAAAATTTAATGTAATATTGAC
ATAGAGTATTACTGATTTTATTAATGATTAATTTTCGTTAAAAAATTTGGTTAATAAA
ATTTCTTATTTTAATCAGATTTATTCTGCGTATAAAATTTAAATTTAAAATCTTACTT
AAACTTTTGCTTAATTAATTTAACAAACACTTCTAAAAAAAAGAAAACATATTAAGA
ATAACAGGTAAAATGCTTTAAAAGTGGTTCTACCTTGAGTTTATAGTGAATATGTGT
AAAAATATCCACTTTTGTATATCAAATTATAATAGATGCTTTTATAAAATAAAATTT
AACTTTCTAGTATATTTTCTTCAAAGGATGGTTAATGTTATTTTTAAAATTTGAATTT
AGATCTCTTTTAAATTGATTGTATCTTTTTTATAATTTGAATATTTTTTAATTTATTTA
AATGTTTTTTAATTTTTACCTTTTAGATTTTATTTAAATTTCAAAATGTCAACATATGT
TACATGAAAACTTGCTAAATACATAAGTGTTTGCATGCCCGTCAGTAATTTTGGTTA
GTGAAGTTTTAATTTGTCAAAAGTTTATTTGCATGTCTAAGATATAAATTATCTATTT
AATATTTTCTCAAATCATACAACCACCTCACATTTACATGTGATCATATTTAGTTTAC
TTATTAAACTGATCAGAGTTCATTTAAAAAACAAATTGTCAACACTACAAAAAAAA
AAAAGTCTCCAAATCAATTATGATTACTTATGCCGAAATTGAAAAAGTAAAAGCAG
ATTTACTATAGTTATTATGGACTAGCTGGAGATGAACAAATAAAGTAGATAAGATCA
TAAGATTGAGAATAAGATTTGGGAACACTAGCCACCAAAAATGCAGTGAGTGACTA
TCCCAACGTGATCATAGTGGGTTTGGGTACGGTTGGTGTCATTTCCCCGTCCAAATCT
ACAGCTTCTTCTCTTTATTTATTTTTTTCAATTAAAGTTTGATTTTAGAATGCAAAATT
CAATATTGTGTCGTATGAAGGTGGTAAGTAAATAAAGAAAATTGATATCGGTGATG
ATTGTTTGTTTGTGGTGTGCGTTAACATTACAATTTACACAGGACGTGATGTTCGGA
GGCACGGAAACGGTAGCGTCAGCGATCGAGTGGGCCATGGCGGAGCTCATGAGAAG
CCCAGAAGATCAAAAGCGGGTCCAACAAGAGCTGGCGGATGTAGTGGGCCTGGACC
GTCGGGCCGAAGAGTCCGATTTCGAGAAACTCACTTATCTCAAATGTGCCCTCAAAG
AGACCCTCCGCCTCCACCCTCCGATCCCGCTCCTCCTCCACGAGACGGCGGAGGACG
CGACGGTCGGCGGTTACCTCGTCCCCAAGAAGGCGCGTGTCATGATCAACGCGTGG
GCCATTGGGAGGACAAGAACAGCTGGGAGGAACCCGAGAGCTTCAAGCCCGCCC
GGTTTCTTAAACCGGGCGTGCCCGATTTCAAAGGGAGCAACTTCGAGTTCATTCCAT
TCGGGTCGGGTCGCAGATCCTGCCCCGGGATGGTGTTGGGGCCTCTACGCGCTCGAGT
TGGCGGTGGCGCACCTCCTTCACTGCTTCACGTGGGAATTGCCAGATGGGATGAAGC
CAAGTGAGATGGACATGGGTGACGTGTTCGGACTCACCGCTCCAAGATCCACGCGA
CTCATTGCTGTGCCAACCAAGCGCGTGGTGTGCCCTCTCTTTTAAAAAAACAACAAT
TTGGATCTTTTTTCTTCCTTTTTTTGTATTTTCTTTTTATCCCTCAATTATACATAATC
ATATTAAAATAATATAAAGGGAAAAAAAGGCAGCTACACAATAAGAATGTGGGAGTA
TTTGGAAGAAAAAAAAATTGTAAACAATCAATTATATGCATTTTGTTATTTTTGCCC
```

SEQUENCES

```
CATTTCCGTTTTGATTCTTATATACGAGTAGAGTAATGATGGAGTCATTCTTTTTAAT
ACTCTTTCTTAAAGACTTTTTTATGATTAATTATAATTCATTAAACAAATATTAATTT
TGATTGATCTTGTTTTTGATTTAATACAAATAAGGAGAATGAATCATTAAATAAGAA
CAACCAAAAATAATATTTTTAAATAAATTCTAATTAATCATAAAAAAATCTTAAAAA
AAGAGTGTCAAAGATAGTACATCTCTCTTACATATTAACAGAATAAAAGTGTACCG
GCCATTAAAAGAGTCAGTAGCTATGGTGGCATAATGGCATGTTACCAATAATTGTTG
TGACAAATTAAGTTGCGCGATTGTGGTAATTTAGTTTCATTTTTTGTCTTCGATGCGA
CAGTGAATAAATTACCACAAGTGCGTACCATGGGGAATTTATTTTTGTTGCGGGGAT
TTCACATCAAATCACGTATTTAACAGTGGTAGTATTGTTTTCTAAGTGGGTTCTAGAG
GCGAAGTTGATGACTTTTGAGTGTGAAAGATTGATAGGAAAGTGTAGCTATTATTAG
AAGGGGCGATACAAATCAACAAGTGTCCCAAAAATCAACATCGCTCAGGTTGATTA
GTCCTGAAAATATATATAACGATGTTGAAATGCATGGACCCTGCGCTATAAATTGCT
TTCCTAATTGAGTTTGAGCGTGGCAATGGCAATGGCAAAAGAATTTTAAGAATGCTT
GCTCACTGACGCTGCTTCTAATGGGAAAGACTTTTTCTACATGCATATGTTTTAAGA
AAAAGAATTTATCGTATAAGAAAAAATCTAGGGCGAAAAATAAGTTACATTAAAAG
CTTGACATGAATTAAGGGTGCCCATGTGAGTCAGCTGTTAACATGAGATGAAAATTT
ATTGAACTTATCTTGAATTTATGTAGTTAATTAGATTTGTCGGTGCGTATTCCGAATA
TGGAAAAGTGGCAGTAATTTGTTTTATATAAGAGAAATGATTGAAGGTGCAGCGTG
GAAAAGTATATTTCAAAGCGTATATGTAATGGCGTGTAATATCGAAACAGAAAGAT
GAATGAGTAGAAGCCGAAGAGTTTAGGTGAGTGTTAAAAAGAACCAGGGGCCATTC
TCTGATTTTATTCAAATTCAATATCAGAAAATGACCCTCGTTGGGCCCTTATTTTGTA
TCCATAAGCAAAGTCAACTGAGGAACTCTTCCGGGGTTGCAAAGCTTTAACTACTTT
GTGATACCAACACAGACTACACTTGTATTTAAGGTCCGTTTGTTTGACTATTTTGCTT
CTGAAGAAGAAATTCTACCACTCGTTTCACACAATGCTTCTTGGTCAGCGTGAACA
CTCGTTGTTTTCAGACGTAGAATCTCAAACAAGTTAAATCGGCAGATTATCATTTGC
TTATGTGTGTCTTGTTAAGGTGTGAAGTTATTACTCTTTACTAGACAGTTAGACATAA
ATATTTTCAATTTGCTGGTCAATCAGACAATGTGAACAAATTCCATAAACAATCAA
ATTTTGATCACCATTAACCTAAAAACAAAACAATAAATGAGGACCGCCCAATTTTGT
GTTTAGTTTATTAGCTAAATAAACCCGTGGAAGGCCTGCTTATGGAGTCATGGTCCC
ATGCCAAGATTTTCTTTTGTTGAATTTAGAGTAGATTTGAAGAGAGACAGAGAGAGA
GAGAGACAACCGAATCTTTTGGAGAGAATGCATAAAATGAAAAAGGCTTTCTTATT
CTTGTAAAATGCAGTACAAAGATTTTGCATATCATTTATATGAATAGTAGGGTCAGC
CCAACAAATTTTGTTGGACTAATACAAATTCTATATTTTAACTAAGGAACAATTAAA
CTAATTCTTTAAGACAAAAGCACATACTAGTACTAGTTATAATTGTCATATGTAACA
GATGATGAAAAAATTATAAA

SEQ ID No: 103
>Soybean_I1J8P0
ATGATCATTCACAATTAATCACATGACTAATTATGATAATTAATCACATTC
TTGGTATGTGAAATAAAATAGTATTCTTATTTTATGAGCAAGTTCCACATTCATAAA
ATAATACTCCATTTTATATTAATTATATTCTTGGTGCTAGTAAAAAATATAATAATA
TTTCACTAAAATATTTATTTGATTAAATTAAATTCTCTAATTTAATTATCAAATAAAT
TATTTTCTTTTGTAAAGATTAGAACACTCGTTTATATGTAACCCCGTAGGTTTAATAC
TAAACTGGTAGTAAATTAATCATAATTAATTTACTAATTAAGGAAGACGTCTAGCAG
CAGTCCATTAAGTCCAAGCATGAAGTAACATCTTTTACCTTCAAGAACAATTGAAGA
ATAATGTAATATTTCATTTCATTGTTGTTTATAACTCAAGGTTAATTCTAAAGTATAA
TATTATTATCAAACTCTAATAAGATAATACATTTAATCAATGAATGACTTAAGAAAC
TCTTTTTCTTTCATTCAATTGTCATGTCTAAGATCTTAATTCTATCATAGAGCTCAAA
CTTGTTACCTAGAGTTGGTGGATTCCTTCTTGATTAATAATTAATTCTATAAGTATTT
AATCATATCCAATATTCATTAAACTAGTGCCTTAAGACATTAAGTGTCTAAAATTTA
AATATAACAAATAATTTGTTAACTATTATGATAATCTCATGTCAAAGGAAACTATTA
TATTTCTTCTTGAGAACTTTCTATTGATATATTAAGATAATATTAACTATTAGGAATT
TTCAATTAAGTCATTTCAATGATGACATCCATATATATATCACTCTATATATGCAATTT
AATAAATAATATTTATTAATTTTTATCTAATAAAGACTTTTACATATATATTAATTTA
TCTGAATTATTGATGTCTTATTCATAATAATCTTACGATTAAGAATAATTTATATTAA
AATTATAAAGGAATTATTTATCATTATCATAATCTTGATCATGATAACAAACCTCTA
ATTTTAATTTTGGACTTGTCAATTCTACTGGAATTTTTTAAAAAAGATGAGTGCATT
GCAGTATGGCAGAAACCTTCTCACAATAGCTGCTATATTTTTGCATGTTAGCTAGTG
ATTTTAATAGTTAGTTTTGGGTGTTGGTAGTTTTCTAGTTGTAATTTTTGTGGATTCTT
TTTGTTGATATATTCCTTAAACATGATTTTAATAGCCTTATCTTTTAATAATTGTGCTG
TAAATGTACTTTAAAAAATTATATCTAAAACGGATCGATTAGAACTTTTTTCATTAA
ATTAATTTTTTAAAAAAAATACATTCTAAGACAGTTTTTTAAAAAAAACCTTCTTAGA
AAGTCTATTTTTTAAGATAGTTTTTGGAAAAATCATCTTAAAATCTTCAAATTTTTTA
ATTTTTTGTTTAAAAAACACATTCTAAAATGGTTTTTTGAAAAAAATCGTCTTAGA
ATCCTTATTAATTTTTTTATTTTTTAAAATGATTCTAAGACGATTCTTTTAAAAAC
CTTCTTAGAAGGATATTTTTTTCTAAGATGATTTTTAATGGAACCGCCGTCGAAAGTC
AAGATTTTCGATGACATTCGCTTCGAAGACAATCTTGAGTCGTCTTTGAATGTAGTT
ATGAATCGTCGTGGAATGATGCTTTTGCAGTAGGTTACAAAATTATTTATCATATAA
TATTAAAATATATAATAAATATTTACTATATTTATTAAAATCTATTTATTATTTAAAT
ATACTTATTTGTTAAATATTTATAATATATCAAATATGATATAATACATAAGTATATT
TAATAATAAATAATATTTGCCTATAACATGAACACAGCAAATTAGAATATATTTTC
TTTTTGTTAAGAACCAAATTAGAATTTAAGAAACTAAAATCATGCAAATATAAAAGT
TTGGAAACTAAAATTATATAATTAATGGTCCAGATTTTTGCAAATAGGTAATCCTGA
AGCTGCAAAGGCAGGAGATCAGATCCCTGTCTCCGTAGTATCTTATTATATTTAATA
TTTAATATATAATTAATTAGAACGTCCACGTTTAATAAGTATCTTGCAGGAAGAAGA
AACTGAAGTGTATATATAGGTCCCCATGACACTCCCCTCAACTCAGCAACAACAACA
CTTACTTGAAGTTGTGCTATTCAATCCCAAAGCCACAGAAATAATATTATTCAGATT
```

-continued

SEQUENCES

TTAGAGACTGAAAACATCATGGCCAACCTCGACCTCGACCCATTCCAGACAAGCAT
CTTAATCCTCGTCCCAATAGCACTCCTGGTGGCGTTACTATCTCGTACTCGTCGAAGA
GCACCCTACCCACCAGGCCCAAAGGGTTTACCAATCATAGGAAACATGTTAATGAT
GGAGCAGCTAACCCACCGCGGCCTCGCCAACCTGGCCAAACACTACGGCGGCATCT
TCCACCTCCGCATGGGGTTCCTCCACATGGTCGCCATCTCCGACCCCGTCGCCGCGC
GTCAGGTTCTCCAAGTCCAAGACAACATCTTCTCCAACCGCCCAGCCACCATCGCCA
TCAGCTACCTTACCTACGACCGCGCCGACATGGCTTTTGCCCACTACGGCCCCTTCT
GGCGCCAGATGCGGAAACTCTGCGTCATGAAGCTCTTCAGCCGCAAGCGCGCCGAG
TCCTGGCAGTCAGTCCGCGATGAGGTCGACGCCGCCGTTCGCGCCGTCGCTAGCAGC
GTCGGAAAGCCCGTCAACATTGGAGAATTAGTGTTTAACCTCACCAAGAACATCATC
TACCGCGCCGCGTTCGGGTCGAGTTCCCAAGAAGGCCAGGACGAGTTCATTAAAAT
ACTGCAGGAGTTCTCCAAGCTCTTTGGCGCGTTTAATATTGCGGATTTTATACCCTAT
CTCGGGTGCGTGGATCCACAAGGTTTGAACTCGAGACTCGCTAGGGCACGTGGCGC
GCTCGATAGCTTCATTGATAAGATCATCGATGAGCACGTGCATAAGATGAAGAATG
ATAAGAGCAGTGAAATTGTTGATGGAGAAACGGACATGGTGGATGAGTTGCTGGCG
TTCTACAGCGAGGAGGCGAAGTTGAACAATGAATCGGACGATTTGCAGAACTCTAT
CAGACTCACTAAGGATAACATCAAGGCTATCATTATGGTATGGATTCGTATTCAAAT
TAATATACTATCTTATTCTTATCAGCCACCTAATGAAATTGATAATTCGTGGCATGAA
AGTTTACGCATTTGACTATTTCATTAAGAGTTGTTAAGAACACGGTTTTTCTCAAAAA
CCACGTAAGCACGTACAACGCCAATACCTCGATGATTGGATGTCTTTTGGAATCCTT
TCTAGTTTAATGAGATTTTTTTTAATTGAGAAATCTAATTTCTTACATGATTTTTTCAA
TGCAAGAAGAGAAGATTCAGATCAATAAGGTTTATGCATGATTATAGAAAAATTGG
ATGAATTTAAGCTTTTAAAAAGTTTATGTATTTTTTAAAATTTAATGTAATATTGAC
ATAGAGTATTACTGATTTTATTAATGATTAATTTTCGTTAAAAAATTTGGTTAATAAA
ATTTCTTATTTTAATCAGATTTATTCTGCGTATAAAATTTAAATTTAAAATCTTACTT
AAACTTTTGCTTAATTAATTTAACAAACACTTCTAAAAAAAAGAAAACATATTAAGA
ATAACAGGTAAAATGCTTTAAAAGTGGTTCTACCTTGAGTTTATAGTGAATATGTGT
AAAAATATCCACTTTTGTATATCAAATTATAATAGATGCTTTTATAAAATAAAATTT
AACTTTCTAGTATATTTTCTTCAAAGGATGGTTAATGTTATTTTTAAAATTTGAATTT
AGATCTCTTTTAAATTGATTGTATCTTTTTTATAATTTGAATATTTTTTAATTTATTTA
AATGTTTTTTAATTTTTACCTTTTAGATTTTATTTAAATTTCAAAATGTCAACATATGT
TACATGAAAACTTGCTAAATACATAAGTGTTTGCATGCCCGTCAGTAATTTTGGTTA
GTGAAGTTTTAATTTGTCAAAAGTTTATTTGCATGTCTAAGATATAAATTATCTATTT
AATATTTTCTCAAATCATACAACCACCTCACATTTACATGTGATCATATTTAGTTTAC
TTATTAAACTGATCAGAGTTCATTTAAAAAACAAATTGTCAACACTACAAAAAAAA
AAAAGTCTCCAAATCAATTATGATTACTTATGCCGAAATTGAAAAAGTAAAAGCAG
ATTTACTATAGTTATTATGGACTAGCTGGAGATGAACAAATAAAGTAGATAAGATCA
TAAGATTGAGAATAAGATTTGGGAACACTAGCCACCAAAAATGCAGTGAGTGACTA
TCCCAACGTGATCATAGTGGGTTTGGGTACGGTTGGTGTCATTTCCCCGTCCAAATCT
ACAGCTTCTTCTCTTTATTTATTTTTTTCAATTAAAGTTTGATTTTAGAATGCAAATT
CAATATTGTGTCGTATGAAGGTGGTAAGTAAATAAAGAAAATTGATATCGGTGATG
ATTGTTTGTTTGTGGTGTGCGTTAACATTACAATTTACACAGGACGTGATGTTCGGA
GGCACGGAAACGGTAGCGTCAGCGATCGAGTGGGCCATGGCGGAGCTCATGAGAAG
CCCAGAAGATCAAAAGCGGGTCCAACAAGAGCTGGCGGATGTAGTGGGCCTGGACC
GTCGGGCCGAAGAGTCCGATTTCGAGAAACTCACTTATCTCAAATGTGCCCTCAAAG
AGACCCTCCGCCTCCACCCTCCGATCCCGCTCCTCCTCCACGAGACGGCGGAGGACG
CGACGGTCGGCGGTTACCTCGTCCCAAGAAGGCGCGTGTCATGATCAACGCGTGG
GCCATTGGGAGGGACAAGAACAGCTGGGAGGAACCCGAGAGCTTCAAGCCCGCCC
GGTTTCTTAAACCGGGCGTGCCCGATTTCAAAGGGAGCAACTTCGAGTTCATTCCAT
TCGGGTCGGGTCGCAGATCCTGCCCCGGGATGGTGTTGGGGCTCTACGCGCTCGAGT
TGGCGGTGGCGCACCTCCTTCACTGCTTCACGTGGGAATTGCCAGATGGGATGAAGC
CAAGTGAGATGGACATGGGTGACGTGTTCGGACTCACCGCTCCAAGATCCACGCGA
CTCATTGCTGTGCCAACCAAGCGCGTGGTGTGCCCTCTCTTTTAAAAAAACAACAAT
TTGGATCTTTTTCTTCCTTTTTTTGTATTTTCTTTTTATCCCTCAATTATACATAATC
ATATTAAATAATATAAAGGGAAAAAAGGCAGCTACACAATAAGAATGTGGGAGTA
TTTGGAAGAAAAAAAATTGTAAACAATCAATTATATGCATTTTGTTATTTTTGCCC
CATTTCCGTTTTGATTCTTATATACGAGTAGAGTAATGATGGAGTCATTCTTTTTAAT
ACTCTTTCTTAAAGACTTTTTTATGATTAATTATAATTCATTAAACAAATATTAATTT
TGATTGATCTTGTTTTTGATTTAATACAAATAAGGAGAATGAATCATTAAATAAGAA
CAACCAAAAATAATATTTTTAAATAAATTCTAATTAATCATAAAAAAATCTTAAAAA
AAGAGTGTCAAAGATAGTACATCTCTCTTACATATTAACAGAAATAAAAGTGTACCG
GCCATTAAAAGAGTCAGTAGCTATGGTGGCATAATGGCATGTTACCAATAATTGTTG
TGACAAATTAAGTTGCGCGATTGTGGTAATTTAGTTTCATTTTTTGTCTTCGATGCGA
CAGTGAATAAATTACCACAAGTGCGTACCATGGGGAATTTATTTTTGTTGCGGGAT
TTCACATCAAATCACGTATTTAACAGTGGTAGTATTGTTTTCTAAGTGGGTTCTAGAG
GCGAAGTTGATGACTTTTGAGTGTGAAAGATTGATAGGAAAGTGTAGCTATTATTAG
AAGGGGCGATACAAATCAACAAGTGTCCCAAAAATCAACATCGCTCAGGTTGATTA
GTCCTGAAAATATATATAACGATGTTGAAATGCATGGACCCTGCGCTATAAATTGCT
TTCCTAATTGAGTTTGAGCGTGGCAATGGCAATGGCAAAAGAATTTTAAGAATGCTT
GCTCACTGACGCTGCTTCTAATGGGAAAGACTTTTTCTACATGCATATGTTTTAAGA
AAAAGAATTTATCGTATAAGAAAAAATCTAGGGCGAAAAATAAGTTACATTAAAAG
CTTGACATGAATTAAGGGTGCCCATGTGAGTCAGCTGTTAACATGAGATGAAAATTT
ATTGAACTTATCTTGAATTTATGTAGTTAATTAGATTTGTCGGTGCGTATTCCGAATA
TGGAAAAGTGGCAGTAATTTGTTTTATATAAGAGAAATGATTGAAGGTCAGCGTG
GAAAAGTATATTTCAAAGCGTATATGTAATGGCGTGTAATATCGAAACAGAAAGAT
GAATGAGTAGAAGCCGAAGAGTTTAGGTGAGTGTTAAAAAGAACCAGGGGCATTC
TCTGATTTTATTCAAATTCAATATCAGAAAATGACCCTCGTTGGGCCCTTATTTTGTA

| SEQUENCES |
|---|
| TCCATAAGCAAAGTCAACTGAGGAACTCTTCCGGGGTTGCAAAGCTTTAACTACTTT<br>GTGATACCAACACAGACTACACTTGTATTTAAGGTCCGTTTGTTTGACTATTTTGCTT<br>CTGAAGAAGAAATTCTACCACTCGTTTCACACAATGCTTCTTGGTCAGCGTGAACA<br>CTCGTTGTTTTCAGACGTAGAATCTCAAACAAGTTAAATCGGCAGATTATCATTTGC<br>TTATGTGTGTCTTGTTAAGGTGTGAAGTTATTACTCTTTACTAGACAGTTAGACATAA<br>ATATTTTCAATTTGCTGGTCAATCAGACAATGTGAACAAATTCCATAAACAATCAA<br>ATTTTGATCACCATTAACCTAAAAACAAAACAATAAATGAGGACCGCCCAATTTTGT<br>GTTTAGTTTATTAGCTAAATAAACCCGTGGAAGGCCTGCTTATGGAGTCATGGTCCC<br>ATGCCAAGATTTTCTTTTGTTGAATTTAGAGTAGATTTGAAGAGAGACAGAGAGAGA<br>GAGAGACAACCGAATCTTTTGGAGAGAATGCATAAAATGAAAAAGGCTTTCTTATT<br>CTTGTAAAATGCAGTACAAAGATTTTGCATATCATTTATATGAATAGTAGGGTCAGC<br>CCAACAAATTTTGTTGGACTAATACAAATTCTATATTTTAACTAAGGAACAATTAAA<br>CTAATTCTTTAAGACAAAAGCACATACTAGTACTAGTTATAATTGTCATATGTAACA<br>GATGATGAAAAAATTATAAA<br><br>SEQ ID No: 104<br>>Soybean_Q2LAL3<br>CTTAATTGAATTTGTCATTCTCCTCCATAATTTACTCATAGCTATTTGATGG<br>CCATCATTTGAAGAGTAAAAATATTGATTTAAAAATTACTGATTTTTTTATTACAAAT<br>ATGATCAAATACATTAAAAAAACAAAATACTGGTTTTGAAAATAGTAAATAAACAA<br>AAGGCCTTATTATTTGAAGTTTTATATAATGAATAAGAATTATTAAATACTCTTCATT<br>TTAAAAGTATAATTTATTTAATTATACTTTTATTTTATTAACATTTTGTCATTCTACTA<br>GATTGACATACAACCGCGGTACTTTTACTAAATGCTCTGAATTTAACTATAATAATG<br>ACTCATTTTTATTAAAGCGAAAAGTAATTCAAATAACATGAACTTTTTGAAGGAAAA<br>CAACATCACTTTAGGTACTGTTTGTACTATTTTTCAATTAAAATTAAAGTTTCTCAGT<br>AATTTATATTGTATTAAAATATTTTGTAGATTATCAAGAAGAATCATTAGCAAAAAC<br>ATACATATGATATTGTACCTAAGGTTTCTCCATAGGAATTCAGTTTTTTAAAGTCAAC<br>AAATTTTACAATTTTTTTACAACTTTAGAGTTGACCTAATATTTATCCAATAAATGTA<br>CTACAAACTTTCTTGAATTTTTTATTCCTGAGTGGGCCAGGAACTTTCTTGAAATTGT<br>ATAATTTTAAAACGTAATAAATACTTTCTTGGAATTAGGAATAGTTGGGAGTACTAT<br>GTTTTTTTAAAGGAAAGTTGGTACCACTATATTAGATTTTAGTTGTTTCAAATTTACT<br>AATTTAATTTGTTTAAAATTATTATAAATGTGTTTTTAATTTTAAACTTTTCTATATAT<br>TATAAGAAAGTTTAACTAACTTCTATACTAATTAAAAAAGTTAAATAATATATTCCTTTT<br>ATCTTTAAATAAATATCACATTTGAAAATATTATCTCAAAATAAATGTCATACATGT<br>TAATTTTTTACTTTAATATTAATTTTTTATTAAGGTTAATTTTATAAAATTATTAATTT<br>TTCATTTATTTATTATTTTTTCTTAATTTATATAAAATAATTTAAAATGACACTTATTT<br>TAAGATAAAAAAATATAATATTATATTAATATCATGACATTGATTTGGAGAATCTCA<br>TTGATAACTTTTAACTTATAGAATCTCATTTCCAACCTTATCTTTTAACATACAAGGC<br>TCAAATTAACTTGACATCTTTCACAAGGAGATTGAGTTTAGTTATTAGTTAATATTAA<br>TTATTTAATTTTACTAATTATATTTAATAAATAATTTTTCTTAAGAGCTCTTCATTGGA<br>ATTGATAAAAAAATAGTTATTGAAAATATATATTCAATTAATTGAATGATATTTTTA<br>GGATAATATTATTAAAAAACTAAAATAGTTAAAACTTAATTATATTTGAGTTCATCA<br>TATCTTTTTTATTGTTTATAATTGACTCCGGAGGTGCTAGGTACTTTCTTGAAATTAG<br>GAATAGTTTGAGATTAAGAAAAATAAAGTGAAATGTATTTAAGGAATATTTATCAA<br>ATATTTATTATAAATATTAAGTAATAAATGTAATAAGTATTTCTTATAAATATTAAGT<br>AATAAATATTCATTAAATATATTAGTATTTTAATACTAAATATGAGTAAAATATAAT<br>AAATAATCGTAAATATTTATTATTTAAATATACTTACTTACTAAATATTTATTATATA<br>ATGCATAAGCATATTTTAAGTATAGTTAATAATAAGAAATATTTGGCTATAACATTA<br>ACACACCAAATTAAAATTTTTTTTATGAGAACGAAATTAAAATTTAAGAAACTAAA<br>ATCATGCATTTATAAAATTTAAAAGAGTAAAATTAGACGTATACAATTAGTGGTCGA<br>GTTTATTTGAATCGGTAGTATCTTTGTTATTATATTAAATTAATTAGAAACGTCCACG<br>TTTAATAAATATCTGAAGAGAAGAAAGTGTATATATAAGTCCACATGAGACTCCCCT<br>GAACCCAGCAACAACAACACTTACTTGTAGTTGCGAAATCATCCAAACACATTCCAT<br>CTATTAAGATTTTAGAGAGTGAAAATGGATTGGCAAAGCATGATGGGCAACCTGGA<br>CCCATTCCAAAGAACAATCTTAATCCTCGTCCCACTAACACTACTCCTGCTGCTGTTA<br>CTATCTCGTACCCGTCCAAGACCGCCCTATCCACCAGGCCCTAAGGGCTTCCCAATC<br>ATAGGAAACATGTTTATGATGGACAGCTAACCCACCGCGGTCTCGCCAACCTGGCC<br>AAACACTACGGCGGAATCTTCCACCTTCGCATGGGCTTCCTCCACATGGTCGCCATC<br>TCCGACCCCGATGCCGCGCGACAGGTTCTCCAAGTCCAAGACAACATCTTTTCCAAC<br>CGCCCCGCCACCATCGCCATCAGCTACCTCACCTACGACCGCGCCGACATGGCCTTC<br>GCCCACTACGGCCCCTTCTGGCGCCAGATGAGGAAACTCTGCGTCATGAAGCTCTTC<br>AGCCGCAAGCGCGCCGAGTCCTGGCAGTCCGTTCGCGACGAGGTCGACTCCGCCGT<br>CCGCGCCGTCGCCAACAGCGTCGGAAAACCCGTCAACATCGGAGAATTAGTGTTTA<br>ACCTCACCAAGAACATCATCTACCGCGCCGCGTTCGGGTCGAGTTCGCAGGAAGGT<br>CAAGACGATTTCATTAAATATTGCAGGAGTTCTCTAAGCTCTTTGGCGCGTTTAAT<br>ATTGCGGATTTTATACCCTACCTCGGGCGCGTAGATCCACAAGGTTTGAACTCCAGA<br>CTCGCTAGGGCACGTGGCGCGCTCGATAGCTTCATTGATAAGATCATCGACGAGCAC<br>GTGCAGAAGAAGAATTATCAGAGCAGTGAAATTGGTGATGGTGAAACGGACAT<br>GGTGGATGAGTTGCTGGCGTTCTACGGCGAGGAGGCGAAGTTGAACAATGAATCGG<br>ACGATAAATTTGCAGAACTCTATCAGACTCACTAAGGATAACATCAAGGCTATCATTA<br>TGGTATGGATTCGTTTTCAAATAAATATATCTTATTCTTATCAGCCACCTAATGAAAT<br>CGATAATTATTCATGGCATGAAAGTTTAAGCATTTTACTATTTCATCCAGAGTATTTA<br>AGATAAGAGCACTGTTTTTTTTTCTCAAAAACCACCTAAGCACGTACAACTTAACGC<br>CAATACCTCAATGATTGGATTGATCTTCAGCTTATCTTTGGATTAATTTCTACTTTAA<br>TACTTTAATGGGATTTTTTATTGTGAAATCTAATTGTTAAATGTTTTTTAGTGCAAG<br>AATATTAAGATCTATAAAGTTTAATTTATTGATGTTCATAGAAAAATTGGATGAAGA<br>ATTAACCTTTTAAAAAGTTTATTTATTTCATCTCCTATACATTTTATATTTTTTATTG |

-continued

| SEQUENCES |
|---|
| GTGTTTATTAAGAAGTTGTCCAAAAAGACTTTTACTATTTTTAATTCTTTATCGTCCT |
| TCACCTTAAAAAGAAAAAAAGTGGCTCTACCTTGAGTATGTATAATATATTGGGAAT |
| GTGTAAAAATATCAACTTTTGTTTGCTAAATTATAATATATTTTAAAAAAATTTACTT |
| TCTGTAAAGGCTGGTTGAATTCGTGATATTCTTAATTTTCAATTTTGAATTTACATTT |
| TTTAAATTAGATATATGTATTTTTAAATGCTTTTTTCAAACATTTTATACTTCATTTAA |
| ATTAAAAATATCAATATATTATACATAAAATGCGTGTTAAATATTTTTAAACCTTTT |
| AGTTGTATAGAAGTATTTGCATGTCTGTTAGTCATCCTAAATTGCTTTGTTTGGAAGT |
| TTTAATTTGTCAGAAGTTGATTTAAGTGCCTAAGTTATAAATTTTCTATTTATGTGTC |
| ATCAATATGTAGTTTACTTATTAAACTGATTTGAGTTCATTTAGAAAACAAATTTTCA |
| ACATTTACAAAAAAATGTCTCCAAATCAATTATGATTATTTATGCCGAAATTGAAAA |
| AAGTAAAAGCAGATTTACTATGATTATTATGGGCTAACTGGAGATGAACAAATAAG |
| GTAGATAAGATCATAAGATTTGGAAACACTAGCCACCAAACATGCAGTACTAGTGA |
| GTGACTATCCCAACGTGTTTCATAGTGGGTTTGGGTTGGTGTCATTTCTCCGTCCATA |
| TCTACAGTTGCTTCTTCTTCTCTCTCTCTTTTTTTTTTTTGTTTCAATCAAAGTTTTA |
| TTTTTGAATGCAAAATTCAACGTTGTGCCCTATGAAGGTGGTAAGTAAATAAAGAAA |
| ATTGATATCGGTGATGATTGTTTCATTTGTTTGTGGTGTGTGTTAATATTATTACACT |
| TTACACAGGACGTGATGTTCGGAGGCACGGAAACGGTGGCGTCAGCAATCGAGTGG |
| GTCATGTCGGAGCTGATGAGAAGCCCAGAAGACCAAAAGCGGGTCCAACAAGAGCT |
| GGCGGATGTAGTGGGCCTGGACCGTCGGGTCGAAGAGTCCGATTTCGAGAAACTCA |
| CTTATCTCAAATGTGCCCTCAAAGAGACCCTCCGCCTCCACCCTCCGATACCGCTCC |
| TCCTCCACGAGACGGCGGAGGACGCCACCGTCGGCGGCTACTTCGTCCCCAGGAAG |
| GCGCGTGTTATGATCAACGCGTGGGCCATTGGGAGGGACAAGAATTCCTGGGAGGA |
| ACCCGAAACTTTTAAGCCCGCCCGGTTCCTTAAACCGGGCGTGCCCGATTTCAAGGG |
| GAGCAACTTCGAGTTCATTCCATTCGGGTCGGGTCGAAGATCCTGCCCCGGAATGGT |
| GTTGGGGCTCTACGCGCTTGAATTGGCGGTGGCTCATCTTCTTCACTGCTTCACGTGG |
| GAATTGCCAGATGGAATGAAACCAAGTGAGATGGACATGGGTGACGTGTTCGGACT |
| CACCGCTCCAAGGTCCACGCGACTCATTGCTGTACCAACCAAGCGCGTGGTGTGCCC |
| TCTCTTTTAAAAATAAAAAAAAAACACTTGGATCTTTCTTTTTTTCCTCTTTGTATTTT |
| CTTTTTATCCCTTAATTATACATAATCATAATAAATGATATAAAGGGAAAAAAGGGA |
| GGTGCGCAATAAGAATGTGGGAGTATTTGGAAGAAAAAAATTTGTAAAACTCTTCTT |
| GATCATTGATGTGAGCTTTTGTGCAGAAACAATTAATTATGTATGTATTTTGTTTCTT |
| TTTGCCTCACTTCCGTTTTGATTAAAAAACTGAAATAAAAGTGAACCGGCCATTGAA |
| AGAATCAGTGGTTATGGTGGCATAATGGCATTACCAATAATTTGTTGTGACAAATTT |
| TTGTCTTCAATGCGACAGTGAATATGCAAGTGTGTCCCATGGGGAATTTTATTTTTGT |
| TGCGGGGATTTCACATCAAATCACGTATTTAACAGTGGTAGTATTGTTTTCTAAGTA |
| AGTGTATTCTAGAGACGAAGTTGATGACTTTGGAGTGTGAAAGATTGAAAGGAAAA |
| TGTAGCCATTATTAGAAGGGGCGATACAAATCAACAACGAGTGTCCCAAAAATCAA |
| CATCGCTCAGGTTGATTAGTCCTGAAAATAAATATAATGATGTTGAAATGCATGGGC |
| CCTGGGCTATAAATTGCTTTCCTAATTGAGTTTGAATACGCTGCCTCTAATGGGAAA |
| GACTTTTTCTACATGTGGCAGTAATTTGTTTTGTATACGAAAGTGCATAGTATTATAA |
| TAGAATTGATTGAAGGTGCAGCGTGGAAAAGTATATTTCAAAGCGTATATGTAATG |
| GCGTGTAAAATCGAAACAGGAAGTTGAGAGTAGAAGTCGAAGTGTTTTAGTGAGTG |
| TTGAAAGGAACGTGGGGCCATTCTTCGATTATATTGAAATTCAATATAAAAAGTTAA |
| AACCGTGAAAATGACCCTTGTTGTTGGGCCCTTATTTTGTATGCATAGGCTAAGTCA |
| ACTGAGGAACTACTCCGGGGTTGCAAAGCTTTAACTACTTTGTGATACCAACACAGA |
| CTACACTTATGTTTAAATTAAAAGCCCCGTTTGTTTGACTATTTTGCTTCTGAAAAAC |
| AAAAATCTGGCACTCGATTAACACAATGCTTGTTTGTCAGCGTGAACACTGGTTGTT |
| TTCAGACATGGAATCTCAAACAAGTCAGCAGATTATCATTTGGTGACATGTGTCTCG |
| TTAAGGTGTCAAGTTATTACTCTTTACTAGGCACTAGACAGTCAGCATAAATATTT |
| TCAATTTGCTAGTTCAATTCAATCAGACAATGTGAACAAATTGCATAAACAATGAAA |
| TTTGATCACCATTAACCTAAAAACAAAACAATAAATGAGGACCGCCCAATTTTGTGT |
| TTACTTTATTAGCTAAATATAAACCCGTGGAAGGCCTGATTATGGAGTCATGGCCCC |
| ATGCCAAGGTTTTTTTGTTGAATTTAGAATAGATTTGGAGAGAGAGAGAGAGAGA |
| GCCGAATCTTTTGGAGAGAATAATATATAAAATGAAAAGGCTTTCTTTCTTATTCTT |
| GTAAATTGCAGTACAGAGATTTTGCATATCATTTATATGAATAGTAGGGTCAGCGCA |
| ACAAATTTTGTTGGATTAATGCAAATTTTGAGGTGGAGCGTAATTATGTCATAAATT |
| CGATTAATGCCTATATTTTAACTAAGGGACAATTAAATTAATTGTCTAAGACAAACA |
| CATACTAGTACTAGCTACTATAATTGTCCTATGTAACAAATGATGAAAATTTTATAT |
| GAATACATTCTTGTAAAATGCAGTACTAAGATTTTGCATGCTACCATTTATATGAAT |
| AGTAGGGTCAGCGCAACAAATTTTGTTGGACTAATACAAATTCAGGTGGAGAGTAA |
| TCATGACATAAATTCGATTAATGTTTACATTTTAACTAAGGGACAATTAAATTAGTT |
| CTCTAAGACAAACACATACTAGTACTAGTTATAATTGTCCCATGTTAACAAATGATG |
| AAAAATTTATAAACACTACAACCAGCTTCCCTTATTTTAGATATTCAAGACTAATG |
| GGCACAAATATTCATATACGAAATGTATCAAGTGAGAGACTTTTTATATATGAGAAT |
| AGGAGAAATGAATATTAATAATTAGATCTTGTCATGAATAGTCAAAATTAAACTAA |
| ACAATTTTTTGAGTTTTAAAATAATCGCCTTACATTAAATCTAATTCCTCCACAAATA |
| ATTACATGGCCTTAGCT |

SEQ ID No: 105
>Soybean_K7MH28
AAGTTGGATCTATAATAAGAGCACGAGGAAGTATTATATAAGACACATTG
AATTTTGATATTTATGATAATGACAATAATTATATATTAATAATTTGAATTTAATGGT
TATGTACTATGTAAAAAAATTTATATTTTTAAACCATAAAAAAGTATTGTTGGTATG
ATAATTAAGATAATTATTATAAAAATAAATAAAATTATTATATATAATTGTTCATAA
TTGAATGATAATGTAAAACTTTACATAAGGTATTTTCTTTAATAATTTTTAAAATACC
ATCAAAGTTGTACACTACATATGTAAAAAAAAAAGTAAAAATATTTGTACACTGC
ATATAATTATAAATGATAAGTGAATCAATAAATAAATATAGATGGATAACTTTAATT -continued

SEQUENCES

```
CTTTTTTTTTTTAATTTGAAACTTTTATTTTTAAAAATTAAAACTCATAAATATAATT
ATCTAAAAAAACTCATCAATATAATAAATGAGTGAATAAATTAATGAATGCACAAA
ATCAAATTCTTATTAATGACACCATTGAAATTTATTATTTTTCTCAATATTAATAATA
TATGTGTTTTTATACGCATTTTTTTATTAAATATCCCATTAATTATCAACTAAAAAGG
AATTTATTAAGCACACTAAATAACTAAATGGGATATTTGGTTAAATAAAAGTGTAA
GTAATTTTTTTTATAAAAAAACACCCAAACCTCTATGAAACTAATTGACACTAAAGT
AATCCTTAAGGGGGAGAGAGACTAAAGAATAGCATTGTTAGGATGTAATTATCTTTA
ATTTTTATTCACCTTTTAATTTTTTCTTATCGATCCACCTATAAAAAATTACACCTTA
AAATGAAAGGAATCAACTTTTTATTTCGTTTATAGTTTTATGCCGTCTTACATGCAT
GCATGGTACAACACGAGCAACACATGGACTCTCTATTTTAATATTTTGTATATTTTAA
AAATGCATGGCTTCATTTACTTGTCTTCTAATCAACAAAACACTCACAGTCACATGA
TCCACTTGCACTAGAGATATTTTTGAAGTCTTTTTTTAATGTATAATTCTTAACCAGG
TCCCACCTTCAAGAAACATGCGTTTATAGTTTTAGAATGGACAAGGATATATGAACA
TCCATGTATTTAAACATTTATTTATCCTACCAAATTATATCATTTACGGTATCAATGT
TTTTTGTCCGATCTTTATTTATTTCTCTTTTAAAGTGCTCAATAGAATAGTGTCCACGT
TGCTTTATTCTTTTAGAAAAATATACATTAACACCTGAAGTGCTAGTTGTCGCTTAGG
GAGAGAAAAATAAATTAAAAAATAGCAATTATAATTGAACATTTATTTGTTATAAAT
ATATGATCAATATTTTTATTTTTTCTATCTACTCTTAACACATCATAAATTCTTAATA
CTTATATTTTTTCACTAGAAATTCTAAATACTTATTTTTTTTTCACTAAATGTCTAA
TAACATTTGGGATGTTCATTATTTAAAAAAAAAATAGAACAATGATAAACACTAACC
ATTTTTTATTTCAAGCATTCACAAATACTTCTCATTTTTCTTTATCTTTTTTTTCCATAT
GTCATACCTACATTATTTTTTGAGTGAATATTTCAACTCCCACTTATTTTAAACATCT
CATCAATAATTTTTATTTCTCTCCATTTCTATCTTTTTATCACATCCTAAACTTTATCA
TATTTATATTATTTCATCTTCTGTTTTCTTTCTCTAGATGTTGGATAACACATTGGAAA
AATATAAATATAATAGATAATTTGTATAATAAAGAAATAAGATGTGTTAATTGAATA
TTTCAAATACGCCTGCAAAGATTTGTCATATGCCAAAGCACATGGGTTTGATATTGG
TTGTAGATATAAGAATTTTATTAGTGAATAAGATGTAAATATATGAGTAAATATTCT
TTCAACTTTGAGATTACCATAATCCTAATAAGTCTCCATATTAATAGGTGTAATATTA
TCATTAATTTATAATTTTTTCGTGACAGAACAGAGACATGTGAGTATCGTCAGAGT
ATATATATAAACCCCGTGATAAGTCCCTGACCTTAGCAATCTATAGCAGCACTTGAA
AACACAATTCATTTCCTTGTTTCCTTCCCAATCAACACATAGAACCAGAGTGCAAAG
CTTTTGCAGTCAGCAAGAGAACCAAAAAAAATCCCACACCATGGATTTGCTCCTAGA
ACTGAAAACCGCACTGGAACCGTTCCGCGAAACACTATTGTTCACAATCCCATTGAC
TCTATTGCTGCTGGGCATAGTGTCCCGAATCCGCAGAAAAACGGCGCCGTATCCACC
GGGCCCAAAAGGCCTCCCCCTAATAGGCAACATGAACATCATGAACCAGCTCACAC
ACAAAGGCCTGGCCAACTTAGCGAAGCAATACGGCGGCGTTTTGCACCTCCGCATA
GGGTTCCTCCACATGGTGGCGATCTCCAACGCAGAAGCGGCGCGTGAGGTTCTCCA
AGTCCAAGACAACATCTTCTCCAACCGCCCCGCGACAATCGCCATCAGCTATTTAAC
CTACGACCGCGCCGACATGGCTTTCGCGCACTACGGTCCCTTCTGGCGCCAGATGCG
CAAGATCTGCGTCATGAAGCTCTTCAGCCGCAAGCGCGCCGAGTCATGGAACACCG
TCAGAGACGAAGTCGACTTCATCATCCGTTCTGTTACGAACAACCTCGGAAGCCCCG
TCAATGTCGGAGAACTCGTCTTCAACCTAACGAAGAACATCATCTACCGCGCCGCGT
TCGGGTCTAGTTCCCAGGAGGGGCAGGACGAGTTCATTTCGATTCTTCAGGAGTTCT
CGAAGCTCTTCGGGGCTTTTAATGTTGCAGATTTCGTTCCGTTTCTTGGGTGGGTTGA
TCCTCAGGGGCTCAACAAGAGGCTTGTGAAGGCACGTGCCTCGCTGGATAGCTTCAT
TGACAAGATCATCGACGAGCACGTGCAGAAGAGGAGGAGTGGCCACGACGGCGAT
GAGGAAAGTGACATGGTTGATGAGTTACTGAATTTTTATAGCCATGAGGCGAAGCT
GAATGATGAGTCCGACGAGTTGCTCAACTCCATCAGCCTCACCAGGGACAACATCA
AAGCCATCATCATGGTACGAACCTCCCTGCCACACTATTTATTTTCAAATGTCTAATA
CATCAAAGCCATCATCATGGTACGAACCTCCCTGCCACACTATTTATTTTCAAATGTC
TAATACATCAAAGCCATCATCATGGTACGAACATCCCTGCCACACTATTTATTTTCA
AATGTCTAATACATCAAAATATTTTATTATTTTAAATTTCTCATCACCATCTTTTAAA
TTAGAAGAGAAAATTATTAAAAAAAAATGAGACACTGAATCACAAAGAAACATCAA
GAAGAAAGTGTAAGAGAAAATATAGCTAACATTCATATATATTTTAATTATATATAT
AAATAAAATGAATACAAATTGTACTTTTCTTAAAAACTATTAAAATAAGATGACTAC
AAATTGTACTTCACTTAGAAATAAGAAATTTTTGTATACTTACGGACTGTCTCGCGT
GTTCATAATTTTAACTTTCAATTTATCAGGAAAAAAAGATTTCATCAAAATATCACA
AAAATTAACGGGAATCATTGATAATACTGTCCTGTTTGGTATGGAGAAGACAAATA
AAAATTACAGTATTAATGAAAGTAAAGAGGGTGAATAAAAATAGAGAAGAAATAA
AATTAAAATAGATTATTTTAATTAAAATTAAAATTAAAGAGGGTGAATACAAAGAT
AGCTAAAAAAAATAGCTGAAAATAATATAATGAATTCCATTTCATCATTTTTAAAA
TTATTTTATCTCGTTTTTTTTTCTTTTATCAAACAAAAAAAAAAATATCATTCTTTCCCC
CTTCTAATTTGTCTGCAACCGAATAAGCACTGCATGTGACAATAATGCAAGAATTTT
TCTTACTCCACACCATTAAATCATCACTTGTAGGAAAAAAAATAATCATCAATGAAA
GTACTATTCACTATGGCTCAACCACCCCCTCATTTCAATTATCAACGAGTCTATGTAA
AGTCGGAAAAAAAAAATTAAAGACTTTCAGACAGTCTGTACGTGCAAAGATGTAT
CATCATCATGAATAATTATAAATTTTCTTACAATATTTTTTTAACAAATCTTCATGG
TTATTAGATGAAAAAATATTAAATATTTTTATTTGTTTATAAGAGTTTAATGGTTATA
TTTAAAATAATTTTATATTATTATTAATCATAAATTATTATTATAACTTTTAAATA
ATTATTATAAAAATTAATTAAATATTATATATATAATAAATTATAATTAAATAATGA
TATAAAATTATTTTAGCTCTAAGTATCCATCCTTCTCAGTCTTTCGACCGCCTCTAAA
AAAAAGAAAAAAAACTTGAGTTGCCAGGAACTGTATAAAAAAGGTTTGAGACTTG
AAAAGAGCAAGATATGTAAGCAGTGGCCATTCCGGTTGCTATTTTCTCTGTTTATAA
TATATTAAATATATGTATTCTTTCATTTATTTTTTTTATAAAGTATTAAAGATATTGGT
AAGAAAATAATTAATGTGCGGGAATATAACTTTACCCAGTATACATGTCAAATAGTA
ATTCACTCAAATAATATATTCTTAGCTAATAAACTCTTGTGCCATGATATTTCGTCT
ATTATTTGTTTTGTGAAAAAGTTGAGGCTAGGACCGCATATTTTCGTCTCTAAGTCAA
```

SEQUENCES

```
ATGGAGTAATATGTGATTATAGATTGATGTGGATGGTATTACATTACAAGAAAACAT
AAAAATAAAAAATAAAAAAATACGCCGACAAAACAATTTCCAAAACTTGTTTCTTT
GTTTAGAAGAAAACAAAGACCATTAGAATTGTATGAAAATTATTTTTGACTTGCTGT
ATAAGGAGAGATTCTTTAAAGATTCTCTCCAACTGGTTCGTTTGTTTAACATAACCTG
GATTCGTTTGTTTCATAAAAAGGATGAGATTTATGGGTAATAAAAAGGGAAGAAGG
GGGAAGAGAACAATTCTTCCTTCCTTTGGACATGGAAAAGGAAAGTGTGCGAGGTT
AGTCCTACGTCACTTGTATCATTTCTCAGTTTATGAATGGAAATTCAGAAACAAAAA
ACGGGTTATATTACTTATATTTTATTTTCTATTTTTTCTTTCATTTTTCTAAAAAAAGC
AACTTTTAACCTTTTTGTGAATTAATGTGTAGAAATACTATTATGCATGTTTTATTAT
TTCATATTTCAGTAATATTTTAGTACTAAATGTTATAATAGGATGAAGCACATTAAA
TTAAAGGATTGATACTATTTGGTTTGTAAAAATAGGGTGGGTTTAGGAAAGAAGG
AAGTGGGGGAGGTGGACGTACTATCAAATCCTTCCTTCCTTTTTTGAACATCGTTG
ACTGTGTAATAATTGTATTTTTTTATAACTGGAAATAATTATATTTGCAGCTAAGTC
CCACATCATTCATATAATTTGTCAATTTATGAACGGTAGAAAAAAAGGGCTACCTGA
CAAAAATATTTTAATTTATATTACATTTATTTTATATTTGAGATACTTATGCTATTTTA
TATTCATGTTTTGTTTCTTCACTTTCTATACAACTAAACAAGTAAAAGGAAATTGTTT
ATCTCTCTTTCATTTCACTTTTTCTTCTGTCGAATAATCTAAAAATTATTATACTTTCT
ACATTTTTTCATTCTTTCACTTTTTTTTTCTTATATCAAACACAACAAAAATGTTAAA
ACAATATTTTACTTTATATACTTTTATATACTTTTATTACTTTTATCATATACTTCAGTA
ATAATATGATGGATTGTCTTAAGAAGAAAGTAATAATATGATGTGACACATCAAAA
TAAAAGATTGAAATGTTTATAGTATCCCTAGTCACATGTATGTGACAAATAGCTTGT
TTATTATTTGTTTAAATTAATAGAAAATGATATTTTTAATATAGTTCGGATATTCTGG
TAATCATAACATATATTCCTGAGTAATAAAAAATGTGAACCAAACGTGTGCTTCAAT
TATTCCTAGACCCAGTGTCCATGCATAATTTTTTTTAAAAAAGATTTTCATGTTACAG
GCAAAAGCATACACTATAATTAACTAGTTAACTACGTATAAAAATATGCAAACTTAGA
TCGGGAGAATGAATGGTATAAACTGTGAAGCCTCAAAGATAAAAAGTCCCCATTGT
TTTAATTTAGTGGTTAATATCGGTGCCAATTATCTTTCGGTCCATGTCATTGTGATAT
TTCAATTTCAAGTTTTGAACAACAACAACAAAATAATACAAACAAAAAGAAAAGAA
AACCAGAAATGAAACTGTTGATGTAATTATTATTTTTGGTTTTTGTGTACACTAGTAA
CCAGTAACACTATTAATGTATAGTATTTGAAACAAGATTTTGGTGGATAGTAACTGA
CAACTATGCAAGACCATGCAGGACGTGATGTTTGGAGGAACCGAAACTGTTGCGTC
GGGAATTGAGTGGGCAATGGCGGAGCTAATGAGAAGCCCAGACGACCTACGGCGCG
TGCAGCAAGAACTCGCCGACGTGGTGGGCTTGGACCGGCGCGTGGAGGAATCAGAC
CTCGAAAAGCTCGTATATCTAAAATGCGCTGTCAAGGAGACGCTGCGGCTGCACCC
ACCTATCCCGCTGCTCCTCCATGAGACTGCGGAGGATGCGGCGGTGTGTGGTTACCA
CGTGCCGAAGGGCTCGCGCGTGATGATAAACGCGTGGGCCATAGGGCGGGACAAGA
GCGCGTGGGAGGACGCGGAAGCGTTCAAGCCTTCGCGGTTTCTGAACCCGCACGTG
CCGGATTTCAAAGGGAGTAACTTTGAGTTCATTCCATTCGGGTCGGGTCGGAGATCC
TGCCCCGGAATGCAACTGGGTCTTTACACGCTGGAACTGGCCATGGCACACTTGCTT
CACTGCTTCACATGGGAGTTACCAGATGGAATGAAACCCAGCGAGTTGGACACGAG
TGACGTGTTCGGACTCACCGCGCCCAGGGCGAGTCGACTCGTCGCAGTCCCATTTAA
GCGCGTGTTATGCCCTCTCTAATAAAAGAAAAAAAAGTATCGCAAGTTTACGAATA
ACGGCCTCGAAGGGCTTCACCAAAGTATAAAAAGAACATGGCGGTGAAGTGCTTCG
GGACTTTAAGGTTGTTTTTTCTTCTTCTTTAATTGATGTTTTTTATTCCTCAATTGTAC
GTGGGTGATCGTGTCTGGAGGAGAACCCAGTTATTGTAAAGAAGACAAGGGGATAT
TAGGTTAAGTTTTCTGTTGATTATTGTAAAGACGATTTGATCTACGTGCGGAAACAT
CATTATTGTTGGGTTCACTTGGTTGTATTTTTTGGTCGCACTCTGGTTTTAGTTGTTTG
CAAACTTGATAAAACCGCAGCAAAACGGAAGTACCTTGCAAAAGTCTTGTCCAGAA
AATTTAGGGTTTTATTAGGCAAAATTTACATGGAGGCTAAATATAAATTATTAAATT
CAGGGGGCAAAATTATTGACAAAGTTTTATAATGTAGTAATTTTAACATTTCACTTTT
AACAAATAATATATATATGACTAATTTATTTAAGTTATTTTACAATATAATTGATTCC
AAATAAAAATTTGAGTAATTTTAATTTTATAAATTAAAATATGATTAATAATATTATTT
TAGTGATGCTTGATTACACTTTCAAAAAAAAAAGTAATGCATGCATTAACAATATA
ATCTTTTCATTATACTTTTTTGAAAAATTATTGTTTAATTATTCAAATCAACAATATTT
TTTAAACTTTAATGTATTAAAAATATTTTTGCAAAAATTATACCTTCTTAGTCTTGTC
ACGGGCGTCTAATTGTCATGTCATTACCTTCAATGACTTGCATGGACGTGTCAATGA
TTGAACATGATGATGTAACACTCTGTTTGTCATATCATCACTTAATGAAAAGATGAC
TAACGGTAGGTAGTAAAATAAAATAATTTTTTTAAGTATGTATTTGATAAAAAAAA
ATAAATTTTTAGATAGTAATCTAAAAACAACCTATTTTTCAGGTATGAAAAACTTAT
TTAATATATGACATGAAAAATTTATTTAAATTATATATAAGTGGTATTTACCGTTTA
TAATTAATGTACATATGTAACATATTATGCATTCTCTCACTATTCCTTCACTATTCTCT
GGATTCAAAATGTATATCCTCATTATTTGATCTTGTTGGATTCTCTTCTAACCTTGTC
CAGATATTAAAATGTATGCATCTTAACTCTTTAATTTTACCTTTAATATTATCTTATT
AATCTAGTTCAATTAATTAAATACGATAAATTGATATATGAGTTATTGTAAATTTCA
AATAGTATTTTTTTAAATGTATTTCTTATTTTAAATGAGGAATTATCTTAAAAAAAT
TAAATAAGATAAAGTTTCTCAAATTTATATAAAATTAAATTACTTATATGTTTATCAA
GTTATTTTAATTAATTTTTAATTTTTTGACAAGTTTACAAATATTTGATCAAATAAAA
GTCTATGAGAATCGATTTTTTTATTGACTTATAAGATTTGCTTTTAAACATAACTTA
AATTTACTATTATCATTTTTATTTTCATTTTCAATAAAATGATAAAATTTATCATTTAT
CATTTTATCTGAAATTAAATTATTTATTTTGATAAAACTCCTCCTTATCATTTGTTAAC
TAAAAAATTATTTTTCATATTGACATAAATAAGTTTTTCATATCTAAAAAATAGACC
AATTTTAGATTATTACCTAAAAATTTATTTTTTGTCAAATATTTACCTGAAAAAAAA
TAGTTTCATTTTACTACTTGTTGTTAATTTCTTTTCGTTAAGTAATGACGTGTGACAG
AGGGAGTGCCAGATTATCATGCTCAATCACTAACACAAGGTAATAACATGATAATG
AAGTATTTGTGATAAGATGTAATGATATGATACTCCATCTGTCACGTCATCATTTAA
CGGAAGGGGAAATTATTGTCAAGTGCTTGGTTGAAAAAAAATAATGTTAAATGATA
TTTAAAAAAACCTATATTCCATGTATGAAAAAATTATTTAAATAAGTTATTTTGTAAT
```

ATTCGTTGTATTGTATCAAAAGATATTTCATACATTTGTTAACTTTTTATTAATGCTTT
TTTTCAAAATTTTATAACAAAGTTTTATAATTTATATATATTCTTTTACAATGACCTTC
TATTTAGATATATTAACAAATTAAGTTTTATCTGAAAAAAAAAATTAATTAAGTTTT
ATAATTTAGTCTACTTTTTCCATTTTTATCCGCTCCATTTCTCACATTTTATTCTCTCTT
ATCT

SEQ ID No: 106
>Soybean_I1LHY5
CTTAATTGAATTTGTCATTCTCCTCCATAATTTACTCATAGCTATTTGATGG
CCATCATTTGAAGAGTAAAAATATTGATTTAAAAATTACTGATTTTTTATTACAAAT
ATGATCAAATACATTAAAAAAACAAAATACTGGTTTTGAAAATAGTAAATAAACAA
AAGGCCTTATTATTTGAAGTTTTATATAATGAATAAGAATTATTAAATACTCTTCATT
TTAAAAGTATAATTTATTTAATTATACTTTTATTTTATTAACATTTTGTCATTCTACTA
GATTGACATACAACCGCGGTACTTTTACTAAATGCTCTGAATTTAACTATAATAATG
ACTCATTTTTATTAAAGCGAAAAGTAATTCAAATAACATGAACTTTTTGAAGGAAAA
CAACATCACTTTAGGTACTGTTTGTACTATTTTTCAATTAAAATTAAAGTTTCTCAGT
AATTTATATTGTATTAAAATATTTTGTAGATTATCAAGAAGAATCATTAGCAAAAAC
ATACATATGATATTGTACCTAAGGTTTCTCCATAGGAATTCAGTTTTTTAAAGTCAAC
AAATTTTACAATTTTTTACAACTTTAGAGTTGACCTAATATTTATCCAATAAATGTA
CTACAAACTTTCTTGAATTTTTTATTCCTGAGTGGGCCAGGAACTTTCTTGAAATTGT
ATAATTTTAAAACGTAATAAATACTTTCTTGGAATTAGGAATAGTTGGGAGTACTAT
GTTTTTTTAAAGGAAAGTTGGTACCACTATATTAGATTTTAGTTGTTTCAAATTTACT
AATTTAATTTGTTTAAAATTATTATAAATGTGTTTTTAATTTTAAACTTTTCTATATAT
TATAAGAAAGTTTAACTAACTTCTATACTAATTAAAAAAGTTAAATAATATTCCTTTT
ATCTTTAAATAAATATCACATTTGAAAATATTATCTCAAAATAAATGTCATACATGT
TAATTTTTTACTTTAATATTAATTTTTTATTAAGGTTAATTTTATAAAATTATTAATTT
TTCATTTATTTATTATTTTTTCTTAATTTATATAAAATAATTTAAAATGACACTTATTT
TAAGATAAAAAAATATAATATTATATTAATATCATGACATTGATTTGGAGAATCTCA
TTGATAACTTTTAACTTATAGAATCTCATTTCCAACCTTATCTTTTAACATACAAGGC
TCAAATTAACTTGACATCTTTCACAAGGAGATTGAGTTTAGTTATTAGTTAATATTAA
TTATTTAATTTTACTAATTATATTTAATAAATAATTTTTCTTAAGAGCTCTTCATTGGA
ATTGATAAAAAAATAGTTATTGAAAATATATATTCAATTAATTGAATGATATTTTTA
GGATAATATTATTAAAAAACTAAAATAGTTAAAACTTAATTATATTTGAGTTCATCA
TATCTTTTTTATTGTTTATAATTGACTCCGGAGGTGCTAGGTACTTTCTTGAAATTAG
GAATAGTTTGAGATTAAGAAAAATAAAGTGAAATGTATTTAAGGAATATTTATCAA
ATATTTATTATAAATATTAAGTAATAAATGTAATAAGTATTTCTTATAAATATTAAGT
AATAAATATTCATTAAATATATTAGTATTTTAATACTAAATATGAGTAAAATATAAT
AAATAATCGTAAATATTTATTATTTAAATATACTTACTTACTAAATATTTATTATATA
ATGCATAAGCATATTTTAAGTATAGTTAATAATAAGAAATATTTGGCTATAACATTA
ACACACCAAATTAAAATTTTTTTTATGGAGAACGAAATTAAAATTTAAGAAACTAAA
ATCATGCATTTATAAAATTTAAAAGAGTAAAATTAGACGTATACAATTAGTGGTCGA
GTTTATTTGAATCGGTAGTATCTTTGTTATTATATTAAATTAATTAGAAACGTCCACG
TTTAATAAATATCTGAAGAGAAGAAAGTGTATATATAAGTCCACATGAGACTCCCCT
GAACCCAGCAACAACAACACTTACTTGTAGTTGCGAAATCATCCAAACACATTCCAT
CTATTAAGATTTTAGAGAGTGAAAATGGATTGGCAAAGCATGATGGGCAACCTGGA
CCCATTCCAAAGAACAATCTTAATCCTCGTCCCACTAACACTACTCCTGCTGCTGTTA
CTATCTCGTACCCGTCCAAGACCGCCCTATCCACCAGGCCCTAAGGGCTTCCCAATC
ATAGGAAACATGTTTATGATGGACCAGCTAACCCACCGCGGTCTCGCCAACCTGGCC
AAACACTACGGCGGAATCTTCCACCTTCGCATGGGCTTCCTCCACATGGTCGCCATC
TCCGACCCCGATGCCGCGCGACAGGTTCTCCAAGTCCAAGCAACATCTTTTCCAAC
CGCCCCGCCACCATCGCCATCAGCTACCTCACCTACGACCGCGCCGACATGGCCTTC
GCCCACTACGGCCCCTTCTGGCGCCAGATGAGGGAAACTCTGCGTCATGAAGCTCTTC
AGCCGCAAGCGCGCCGAGTCCTGGCAGTCCGTTCGCGACGAGGTCGACTCCGCCGT
CCGCGCCGTCGCCAACAGCGTCGGAAAACCCGTCAACATCGGAGAATTAGTGTTTA
ACCTCACCAAGAACATCATCTACCGCGCCGCGTTCGGGTCGAGTTCGCAGGAAGGT
CAAGACGATTTCATTAAAATATTGCAGGAGTTCTCTAAGCTCTTTGGCGCGTTTAAT
ATTGCGGATTTTATACCCTACCTCGGGCGCGTAGATCCACAAGGTTTGAACTCCAGA
CTCGCTAGGGCACGTGGCGCGCTCGATAGCTTCATTGATAAGATCATCGACGAGCAC
GTGCAGAAGAAGAATAATTATCAGAGCAGTGAAATTGGTGATGGTGAAACGGACAT
GGTGGATGAGTTGCTGGCGTTCTACGGCGAGGAGGCGAAGTTGAACAATGAATCGG
ACGATAATTTGCAGAACTCTATCGACTCACTAAGGATAACATCAAGGCTATCATTA
TGGTATGGATTCGTTTTCAAATAAATATATCTTATTCTTATCAGCCACCTAATGAAAT
CGATAATTATTCATGGCATGAAAGTTTAAGCATTTTACTATTTCATCCAGAGTATTTA
AGATAAGAGCACTGTTTTTTTTTCTCAAAAACCACCTAAGCACGTACAACTTAACGC
CAATACCTCAATGATTGGATTGATCTTCAGCTTATCTTTGGATTAATTTCTACTTTAA
TACTTTAATGGGATTTTTTTATTGTGAAATCTAATTGTTAAATGTTTTTTAGTGCAAG
AATATTAAGATCTATAAAGTTTAATTTATTGATGTTCATAGAAAAATTGGATGAAGA
ATTAACCTTTTAAAAAGTTTATTTATTTCATCTCCTATACATTTTATATTTTTTATTG
GTGTTTATTAAGAAGTTGTCCAAAAAGACTTTTACTATTTTTAATTCTTTATCGTCCT
TCACCTTAAAAAGAAAAAAGTGGCTCTACCTTGAGTATGTATAATATATTGGGAAT
GTGTAAAAATATCAACTTTGTTTGCTAAATTATAATATATTTTAAAAAATTACTT
TCTGTAAAGGCTGGTTGAATTCGTGATATTCTTAATTTTCAATTTTGAATTTACATTT
TTTAAATTAGATATATGTATTTTTAAATGCTTTTTTCAAACATTTTATACTTCATTTAA
ATTAAAAATATCAATATATTATACATAAAATGCGTGTTAAATATTTTTTAAACCTTTT
AGTTGTATAGAAGTATTTGCATGTCTGTTAGTCATCCTAAATTGCTTTGTTTGGAAGT
TTTAATTTGTCAGAAGTTGATTTAAGTGCCTAAGTTATAAATTTTCTATTTATGTGTC
ATCAATATGTAGTTTACTTATTAAACTGATTTGAGTTCATTTAGAAAACAAATTTTCA

SEQUENCES

ACATTTACAAAAAAATGTCTCCAAATCAATTATGATTATTTATGCCGAAATTGAAAA
AAGTAAAAGCAGATTTACTATGATTATTATGGGCTAACTGGAGATGAACAAATAAG
GTAGATAAGATCATAAGATTTGGAAACACTAGCCACCAAACATGCAGTACTAGTGA
GTGACTATCCCAACGTGTTTCATAGTGGGTTTGGGTTGGTGTCATTTCTCCGTCCATA
TCTACAGTTGCTTCTTCTTCTCTCTCTCTTTTTTTTTTTTGTTTCAATCAAAGTTTTA
TTTTTGAATGCAAAATTCAACGTTGTGCCCTATGAAGGTGGTAAGTAAATAAAGAAA
ATTGATATCGGTGATGATTGTTTCATTTGTTTGTGGTGTGTGTTAATATTATTACACT
TTACACAGGACGTGATGTTCGGAGGCACGGAAACGGTGGCGTCAGCAATCGAGTGG
GTCATGTCGGAGCTGATGAGAAGCCCAGAAGACCAAAAGCGGGTCCAACAAGAGCT
GGCGGATGTAGTGGGCCTGGACCGTCGGGTCGAAGAGTCCGATTTCGAGAAACTCA
CTTATCTCAAATGTGCCCTCAAAGAGACCCTCCGCCTCCACCCTCCGATACCGCTCC
TCCTCCACGAGACGGCGGAGGACGCCACCGTCGGCGGCTACTTCGTCCCCAGGAAG
GCGCGTGTTATGATCAACGCGTGGGCCATTGGGAGGGACAAGAATTCCTGGGAGGA
ACCCGAAACTTTTAAGCCCGCCCGGTTCCTTAAACCGGGCGTGCCCGATTTCAAGGG
GAGCAACTTCGAGTTCATTCCATTCGGGTCGGTCGAAGATCCTGCCCCGGAATGGT
GTTGGGGCTCTACGCGCTTGAATTGGCGGTGGCTCATCTTCTTCACTGCTTCACGTGG
GAATTGCCAGATGGAATGAAACCAAGTGAGATGGACATGGGTGACGTGTTCGGACT
CACCGCTCCAAGGTCCACGCGACTCATTGCTGTACCAACCAAGCGCGTGGTGTGCCC
TCTCTTTTAAAAATAAAAAAAAAACACTTGGATCTTTCTTTTTTTCCTCTTTGTATTTT
CTTTTTATCCCTTAATTATACATAATCATAATAAATGATATAAAGGGAAAAAAGGGA
GGTGCGCAATAAGAATGTGGGAGTATTTGGAAGAAAAAAATTTGTAAAACTCTTCTT
GATCATTGATGTGAGCTTTTGTGCAGAAACAATTAATTATGTATGTATTTTGTTTCTT
TTTGCCTCACTTCCGTTTTGATTAAAAAACTGAAATAAAAGTGAACCGGCCATTGAA
AGAATCAGTGGTTATGGTGGCATAATGGCATTACCAATAATTTGTTGTGACAAATTT
TTGTCTTCAATGCGACAGTGAATATGCAAGTGTGTCCCATGGGAATTTTATTTTTGT
TGCGGGGATTTCACATCAAATCACGTATTTAACAGTGGTAGTATTGTTTTCTAAGTA
AGTGTATTCTAGAGACGAAGTTGATGACTTTGGAGTGTGAAAGATTGAAAGGAAAA
TGTAGCCATTATTAGAAGGGGCGATACAAATCAACAACGAGTGTCCCAAAAATCAA
CATCGCTCAGGTTGATTAGTCCTGAAAATAAATATAATGATGTTGAAATGCATGGGC
CCTGGGCTATAAATTGCTTTCCTAATTGAGTTTGAATACGCTGCCTCTAATGGGAAA
GACTTTTTCTACATGTGGCAGTAATTTGTTTTGTATACGAAAGTGCATAGTATTATAA
TAGAATTGATTGAAGGTGCAGCGTGGAAAAGTATATTTCAAAGCGTATATGTAATG
GCGTGTAAAATCGAAACAGGAAGTTGAGAGTAGAAGTCGAAGTGTTTTAGTGAGTG
TTGAAAGGAACGTGGGGCCATTCTTCGATTATATTGAAATTCAATATAAAAAGTTAA
AACCGTGAAAATGACCCTTGTTGTTGGGCCCTTATTTTGTATGCATAGGCTAAGTCA
ACTGAGGAACTACTCCGGGGTTGCAAAGCTTTAACTACTTTGTGATACCAACACAGA
CTACACTTATGTTTAAATTAAAAGCCCCGTTTGTTTGACTATTTTGCTTCTGAAAAAC
AAAAATCTGGCACTCGATTAACACAATGCTTGTTTGTCAGCGTGAACACTGGTTGTT
TTCAGACATGGAATCTCAAACAAGTCAGCAGATTATCATTTGGTGACATGTGTCTCG
TTAAGGTGTCAAGTTATTACTCTTTACTAGGCACTAGACAGTCAGACATAAATATTT
TCAATTTGCTAGTTCAATTCAATCAGACAATGTGAACAAATTGCATAAACAATGAAA
TTTGATCACCATTAACCTAAAAACAAAACAATAAATGAGGACCGCCCAATTTTGTGT
TTACTTTATTAGCTAAATATAAACCCGTGGAAGGCCTGATTATGGAGTCATGGCCCC
ATGCCAAGGTTTTTTTTGTTGAATTTAGAATAGATTTGGAGAGAGAGAGAGAGAGA
GCCGAATCTTTTGGAGAGAATAATATATAAAATGAAAAGGCTTTCTTTCTTTATTCTT
GTAAATTGCAGTACAGAGATTTTGCATATCATTTATATGAATAGTAGGGTCAGCGCA
ACAAATTTTGTTGGATTAATGCAAATTTTGAGGTGGAGCGTAATTATGTCATAAATT
CGATTAATGCCTATATTTTAACTAAGGGACAATTAAATTAATTGTCTAAGACAAACA
CATACTAGTACTAGCTACTATAATTGTCCTATGTAACAAATGATGAAAATTTTATAT
GAATACATTCTTGTAAAATGCAGTACTAAGATTTTGCATGCTACCATTTATATGAAT
AGTAGGGTCAGCGCAACAAATTTTGTTGGACTAATCAAATTCAGGTGGAGAGTAA
TCATGACATAAATTCGATTAATGTTTACATTTTAACTAAGGGACAATTAAATTAGTT
CTCTAAGACAAACACATACTAGTACTAGTTATAATTGTCCCATGTTAACAAATGATG
AAAAATTTATAAACACTACAACCAGCTTCCCTTATTTTTAGATATTCAAGACTAATG
GGCACAAATATTCATATACGAAATGTATCAAGTGAGAGACTTTTTATATATGAGAAT
AGGAGAAATGAATATTAATAATTAGATCTTGTCATGAATAGTCAAAATTAAACTAA
ACAATTTTTTGAGTTTTAAAATAATCGCCTTACATTAAATCTAATTCCTCCACAAATA
ATTACATGGCCTTAGCT

SEQ ID No: 107
>Artichoke_KVI02897.1
TGTTGTGTTATGTATTGTTTTAATTGTAAGGAATATAGGACAAAAATTAGT
CTTCTCTTCTTCAATACAATCATTTTTATGTTATATAATATTTTTGGAATAACTTCAAA
ATTACATAACGAGTTATCTCATTTTAAATGATTAAGTCCTTGAACTATTTTTTAAAT
GAAAAACACCATTAATTTTTTTTTAATGAAAAACCATTAAACTTTTTCATTTTTATTA
ATTAAATCCCTGGACATTTAAAAAAATAAATCATGCATTTTTAAAACTTGGTTATCT
ACATCATTTTAACTCAAAAAAATTACATTACTCAACTAGCAATAGTTCGATGGTTTG
TTTATTTAAAAAATCAGGTTTAATCATTCAAAATGAGAAAGTTTAATGGTTTTTTTAA
TTAAAAAAATAGTTCCGAAACTTAATCATTCAAAATGAGAAATGTTTAATGGTTTTC
TTCATTCAAAAATATAGTTTAAAGACTCAATCATTTAAAATGAGAAAGTTTGTTGAG
TTTTTTTGGACTTTTCTCTAATTTTTCTATATAAATCAATATATTTGTCATTTGTGTAT
GTATTTGTAGGACATTAAATATGATTAAGTATATGTATATTAATTCATGGAATAAT
TTAATAAAAAGTAACAAAAAAATACAATTGTTAGTATTATAAATATATATATAT
ATATATATATATGTTATTTTCCAATATTTATTTATTTTTAAATATGTTATTAAAATTT
ATATAAATAATTAAAAAATCTAATTAAGAAGAGGTTGAAAAAAACGTGAATATAGA
TGCTTGAAAATGGTTTGGAAAAGTAGTCTGGTGTGGCAAGACTGCAAAACGTTTTAG
CACAAATTATTATAATATTTTTATTGGAGTTGGTTATTATACAACTTTTGATATTTGT

SEQUENCES

```
GTAACCAATATAACATAATTTCAATTGTCCATTTCATTTGATTAATATGTGATTTCAT
AAAAAATTTGATTGTTTTCTAATATAAAGTATTGATCATAATTAATGAACCATATTC
ATCTTCTATAAATATTCAAATCATAATAAATGAACTCTTATCATTTCCATAAATATCT
CAATTTATTGGGTTGTATTGATTGTATAAATACGACGGGTTGTATTTGAAACAAACT
CTATTTTTATTTTTAATAAAGCTTTGTTATGATATTATACTCACAAAAATATACAAGT
CATTATTAAATTAAAATGATTTGAGAATAACTAATAAAATTAAGTCATTATTCTTTTA
TATTATATTTCATATAATTTTATTAATTATTTAAAATATATTATCTAAATTATACAAT
ATTGTTGATATAACACATTAATGGAAATTAATTTTTAAATTGGTTTATAAATTACAG
ATATATCATAAATAATTACACTGATAGATGTAGGAATGATCTTACATGATTAACCTG
CTAATATAAGATGATTTTGGTATATTATACCATTTTAGATTGTTATTTATTCATTTAA
CCAGCTATCTATATCATATTTTTCAGTATTTGAATACTACTGTATTTTTTAACCAGAT
TTTATATAAGATTGGTTAGAATTACCTATAATTAACCTTTTACTCGAAAATATTTTGA
AATCTCTTTATCATGTTTCCTTTTAAACAATAAGAGTAGAATTATGACATTATTTTAA
TTTATATTTGATTTTTTCCTATTTTTAATTGACATATACATAAAATATATATGTATATA
TATATATATATATTTATCATATATGTGATAAGAAAATTAGCTTTTTTATTTTTAAAAT
ATTATGAAAAAATGAAAATTAAAGTCAAACAATTTGGGAATTAATTTAGAAAAATA
TAAATAATTGGAAACTGGAACTCATTCAAACAGGAACCACCCACCTTACCCTGTATA
TATACATCCCCTTATTTCTTTCATTAACGGGCAACCTTCTCTCAGTTGCACTTCGTAG
TATTACACACATACATATTCCGATACGACGGTTCTTCGCCGGAAAATATGGATGTTT
TACAACTCCAAGGGCTATTACACCCTATGCCCATCCTATTTTACGTTGCACTCCCTCT
CTTAACTTTCTTCCTTCTTTCCAGTTTTCGCCGGAAACCTCTTCCGCCGGGTCCAAGG
GGGTGGCCGCTGATCGGGAACATGTTGATGATGGATCAACTAACCCATCGTGGTCTT
GCTAGTTTGGCTGACAAATACGGCGGTCTGCTTCATCTCAAGATGGGCTTCAGCCAT
ACAGTCGCTGTCTCGTCACCGGAAATGGCGAGACAAGTACTCCAGGTGCAAGATAA
CGTCTTTGCCAACCGTCCGGCCACCATCGCCATCACTTACCTCACCTACGACCGGGA
AGACATGGCGTTCGCCAACTACGGTCCCTTCTGGCGCCAGATGCGTAAGCTTTGTGT
CATGAAGCTATTCAGCCGGAAACGAGCGGAATCATGGGATTCCGTTCGGGATGAAG
TTGTCTCCATGATCAAATCACGGCGGCTAGTTCCGGCTCCGCCGTTAACCTTGGTG
AGCTCGTGTTCGGGCTGACCCATGACATCATCTACCGAGCCGCTTTCGGGTCGATTT
CCCATGAAGGAAAAGAAGAGTTCATCAGAATTCTTCAAGAATACACCAAGCTTTTTG
GTGCTTTCAACTTGGCCGATTTCATTCCATGGCTAGGGTTTATCGACCCCGCCGGACT
GAACACCCGATTACCAAAGGCCCGGGGTGAGTTAGACGGGTTCATCGATAAAATTA
TCGACGAGCACCTCCGGAAAGAGAAGAAAACCGGCGACGACGCCGACAACGATAT
GGTGGACGAGATGTTGGCGTTTTACAGTGAAGAAGGAAAGGTGAACGAAGGCGAG
GATTTGCAGAACGCGATTAGGCTCACGCGAAACAATATCAAAGCCATTATTATGGTG
AGTTATTTTTAATATTTTATTTTTGTTAAAATACCAAAAATAACAAAGTTTATGATC
ATAAACATATTTATTAATTAATTAATTAATTAAATCATAACCGTGATGTTTGATTGGT
TTGAGTTTGGCTCCAAATATCAAAGGTATTAGGAGGTCCAAGGTTCAAATCCAAGAA
GGAATAAAAATTCTCTTATGGTCACGGAGGTTCAAATACGGTGACTCCGGGTTATCT
GTAAAGTAGGTGGTCGTCCTAGGACTAGTCAGCTCGCATAGTGGGTTGTATATCCTG
GTTAATAAAAAAAATATTATATATATATATTTTGCTTGAAATATAATCTAATGAATA
TAAATATGTGTTAATCCACAAATTAAGTAACGTTTCCCCTTATAAAAGACCTTTGATT
TAGAGTCAATTTGGTAACATGTATAACAATTAAATGAAATCATAAATTCTATTTATT
TATAAAAAATTAAATATTTAATACATATTTTATATAAAAAAAATATTTAATGCAAT
TTATTTCTTTAGAAGCCGTAAAGTTAAGTGACCCCATTTCATTAAACTTTTTCTTCAT
TTTAATAATTAATGATTTTAATTTATTTTAAAATAATCATCAAAAAACAAAATTTATA
TAACAACCGATGTCATCTTCTTAATTTTGTTTTCACTTATAAAACAAATATTTAATGG
TGAAGATCATGAATGATTCCATCTCCATGCTCTTGTTAACCCCAATTAATTGTCTTTT
TTTTGGGTTTTTTAATCTAATTAATTAATTTTGTGCTTATTTTATCCTTCAATTAGTA
TATTATTTTGAATAAAAACAGATTGTATTAGTTGAAATGGGCAAACATCCACAATCT
TGATCAAGTCATCAAATGGGATATCGATAGAATTATATATATATATATATATAT
AGATTTGGGATCATATGAGAAAAGCATGTTTTCATGAGACTCGTGACACCAACTTTT
TACATTTGAAACTTCATCGTGTTTTTTGTTGTGAAGGTTCAACTTTTTTAAACCTTCA
CAGTGTTTTTGCTGTGCAGTTTCACGTGTAAAAATATGGTTTCACGGGTCTAACGAA
AACAGTCTGGTCTGACGTGAACCCAACCATATATATATATATATATATATATGAAAA
GATGACATTAGTTTTGCTTAATAAAGAATTAACATTTGGTAAATTATGGCTTTCTTAT
AGGATGTGATGTTTGGTGGGACTGAAACCGTGGCTTCGGCGATCGAATGGGCTTTGA
CGGAGCTCATGCATACACCAGAAGCACTCAAACGTGCACAACAGGAGCTCGCCGAT
GTCGTTGGCCTTGACCGCCGTGTCGAAGAGTCTGATTTCGAGAAACTGACCTACTTC
AAATGCATCATCAAAGAAACCCTCCGCCTCCACCCTCCCATCCCGGTCCTCCTCCAC
CAGTCATCGGAGGCCACAGAAGTCGCCGGCTACCACATCCCAAAGGGAACACGAGT
CATGGTTAACGCATACGCCATCAACCGTGACAAGAACGCTTGGAAAGACCCCAACA
CATTCAACCCATCTCGATTCTTGGAAAATGGAGCTCCGGATTTCAAAGGAAGCAACT
ACGAGTTTCTTCCGTTTGGGTCTGGCCGGAGATCTTGCCCTGGGATGCAGCTTGGGT
TGTATGCGATGGAGATGGCGGTGGCCCACCTCCTCCATTCGTTCACATGGCAGTTGC
CGGACGGGATGAAGCCGAGCGAGATCGATATGACTGACGTGTTCGGACTCACGGCA
CCAAAGGCGACTCGGCTGGTGGCAGTGCCAACTCCTCGACTGTTATGCCCACTGTAT
TAATCGACGAAGGGTCGGATCTTGACTTCCGAGACACTGAAAAATTGTTGATGTTGC
ATGAACGAATTCGAATGGTTTTAAATTTTTTTTCTTTTTTGTGGTCATGATTTTTTTT
CGTAAAGCAAGATCGATATACAAAAAGATAAATAAAGATTTCAATTTCATGTACATT
AATTCATAAACTCGATTTCAATTCCATATATTTTCATTCATAAACGATATCGATAGCT
TTTGTTTTGAAAGGTACGTAGCGGAGCCATCCACATTGTACGGATAAGGCAAGTAGG
TGGTATTCGGAGTTAAAAGTGCAAAGGCCTTTCTTTCTTGAAGGGGATGTTTGGTTC
GGAAAATGAAGATGGTAGGTTGTATGGTTTAAGACGGATGGATACGTACCAAGTTA
AGGAATAAATTATTTGAAACAATTTTATCATGTTAAATAATTTCATGACACTAAAT
GAACAATGAAATTGATGGTTTTTACGGTTTGTATAAATGATATGGTTTGCAAATAT
CCCTATCCCCCCTATCTCTCAATCTCTCTCTCTCTATATATATATATAGAGAGAGAGA
```

-continued

SEQUENCES

```
GAGAGAGGGGGGGGGAGTGATCAAATACAAACCATTTAATTTGTACAAACCGTGCA
AAGCTCATTCAACCAATCATAATTTTTATTTTGTTAATTTTTTTTGTAAATTTGAGA
GGTTGATTAATCATTTTGATAATACAATTAAAATGAGAATATGATAAAGAAAGAA
AGAGGTTGTTAAATAATTTTATTAAATACAAAATAAGATTATTAAATTACTAATTTA
CTGTTTTTATTTTATTAAAAAATAATATTAATTATTGGAAGTGATTTGCTAATATTAA
ATCTCACGATTATGACAAGCTATCGAGTTCTTATTTTTTGAATATATATATATATA
GAGAGAGAGAGAGAGTTTACTTTGCGAACCACGTTATTTGTACAAATCGTACAAACT
TCATTCAATCAATCATAATTTTTCATTTTGTTCATTTTTTTTGTAATTATGAGAGGTTG
ATTAATCATTTTTATTGTTGAGGGTGTTAATCATGGATCTTATCATCTTCATTATTTTA
ATTTTAGAGAAATAATGAAACAGTTTCATTAAAATTTAATTAAGTATTATATGAAAC
AATTTCATAACCATATATAAAACGACTTCATCAAAAAAAATATTATATGAAACAATT
TCATAATAATTTTTTATAAGATTAAACAATGAAATCGACGGAATAAAATGGTTTGTA
TGATTTGTATAAATTGGGTAGTTTACATTTGATCGTTCATCTCTATGAGGGGATGT
ATAGTGTAACGTCAAAATTAAGAATTTGATTTATATTGAAAACTTGAGAATCAATCC
ATCGATTAGATGAAAAGTTATATTTCCAATGTTTTTTATATAGGTTGCAAGGCATAT
ATGTAATTTCATAATTATGGAAAAAGTTATATCTCTTTTTTTTCCCTTAATTGTTTATG
TAATTTACACTTGTATTCATTTACAAAATTAAAAAACTATAATTATTTTATTTATAAA
TTATTTTCAAGATTATTTAAATAACTTTAATATATCAAAATATGTAGTCAAAAATCA
AGATGAGTGCATTTGACAATAAAATGGTAATCAAGACGGAAAAAAAGTGAGACGTT
CAATCTGTTAAGAAGTAAGGCATAGTTCTAGGAGTTATAAAAACCAGAAGAAAGAT
GTTCTGGTGCATTAAAAACATAGTTTGTAGGTCACGAAAAGTTGCACGTAGGGTTTG
AACTTTGAAGTTGAAAAATGGCTTCTGGTGCTGAAAAGTAGAAGTTTGTTACATTAA
TTGAGAAAAAAAAGTTTGTTACATTATATAGAAACTAAACCAAAGTTGTTACATTTT
GTCCTAAAAAGTAAAAAACTAAAGTTAGAAGAAAGTTCGGTTTGTTCAAAGTCTCAT
TAACGTGGTTCAGATCTGGCAAGGTAAGATCGAACGTAGACTTGTGGTCTGGCT
```

SEQ ID No: 108
>Artichoke_KVH92322.1
```
ATCTTAACTAAAGTTACTTTTCAGGTCGATCTGTATCAGGATAAAATTAAT
AAATAATCGAAGTTTGATAACTTAACACGTTGTTTCTAACACGGAAACTAACTTCTA
GAATTTCATCTGGGCTTCCACTACAACATAACATGACAATCATATTTCGAAGAGTCA
TATAAAAGATATAATATACATCATTTCGCTTAACGTGTTTTTATTGATACAGTATAAT
ACGACATTTAGTAGGACACCTTTTTGTACAACATCTTGTAGAAATAGTTAATTGAAC
ACTTATGAATTGTTTATGAAATGTTTACTTGGTAAGCTCTTACCGGATCACTTACCTT
ATTGGATAAACATGACAATGATCGACCTAGTAAAAGGGATGGCAATGATCAGTAGG
CTTACCCGATAAGTAAGTTTGTTGACTCTTACTCAGTAAGCGTTTATCGGGTAAAATT
ATTGCATATAGTGTCGTTTTAGTGGCTTAGAATCTTGCTTGGTAAGGTAATTGAGAG
TGTTGACTCTTATCAGTAAGTGCTTACCAGGTAAAACGTTTGGGTAAACAACCTCTT
AATTTGTAGGATCTGTAGACTGGTGTCCTATAAAACAGTTATTGGGACACTGATATG
TATTACTAAATGTAATAGTAGTTAATCATATTTTACAACTACATAAAAGTGTCCTA
CGTTATACTCTAGCTATTAGGAATTTTTAGTGTTACATAAAACATGTTATTAGACCCT
TGAATTTATTTCATAATTATAGAATTTGTTAGGTCGTTTAGCTTTGTCTTAACAACTT
ATTGTAACACATTTAGATAAGACATCAATGTTTTGATCCTATAAATTAAAGGATCCT
AAAAATAGGTTTGTAAAACACTACTACACATTCTAATAGGTGTATTTTGTTACAATT
GTTCATAATATTTATTCCAATCTTTTAGCCACAACTTTTTATTTATTTATGTAAAAGT
AGTATTTTGAAAATATTTGATTAATAGTCAAATAATAATGTAAAAAGCCTTCAACGT
GTAGCTCAGTAGGCATAGAGTCAGGACGACTTTGTCCAAATACATGATAGGTCATG
GGTTCTAACTGCCCTTGTTAGTCTCAACCATTAAGAAAGACAAAAATATCCCCTTA
CATCGGTGCGTATGTCCGTGTGATACTGATTGGTGTTATCGATAATTACTTTTTTGT
CCACATAAAACCATTTTGGGGCTAAAATAATATGGTGAACAAGGATGGAAACAACA
AGGACATTCCAACCTTTTTGGAGGCCCTGCTACATCCAAAACTTTTGATTACATTGC
ATAAATAAGATGACAGATGATATATGTCAAGAATAAAAATGGGTTAAACTTAAAAC
GATTAACAAGTATATTTGGGATCCAAAATTTCGGAGGCCCTAATCAAAATCTCACAT
TTAACATGTTAAGGGACGGCCCTGGAAAACAGTATGGTACGGGGCGGATAAAGCAT
CCCTCGACCAGACCAGACCCGACCTCGAACCAGTCCTCGACTAGACTAGACCCGAC
CTCGAACCCGACTAATCTCCGACGGGTTTGGAGGGAAGGAATCCCTAGAGGGTTTG
GGAACCCATTGGGTACCCCTCTAATATATATATATTTTTTAAATTATAATTAATTAT
CACTGCATAGTATAAAGGCCGAGTCTTTTTATATCACATCGGATGCATATACATAGA
GATACAACCACCCCAAATTAAGATGTAGGCCACTCTCTTGATTTGACGTTCAATCTT
ATATATCATATAATAATAAATAAATAAATAATTAATTAATGCATTTCAAGACAAGCG
GATTTAGTCAATATTTTCCATTCATTATTTCAGAAAAATAAGACTAATAATAAATAG
TAAATCACTGTACACTTTCAAACAGGGTGTGCCCGATGAAACCTGTATATATACACC
TCTTCATTTCACTCCTTAGGTAGCAACAACCAACCAGTTGCCACTTATCTCTCCACTT
GAATCAATAATGGATTCTATCCAAATACCCATATCAATCTACGTTATCATTGCCCTCT
TAACCTTTTCTTTTCTAGCATGGCTACGCCGGAAAAACCTCCCGCCCGGCCCTATGG
GCTGGCCGGTCATTGGCAACATGTTGATGATGGATCAGCTCACCCACCGTGGGTTAG
CCCGTTTGGCTGAAAAATACGGTGGCATCCTCCATCTCAAGATGGGTTTCCGTCACA
CCATTGCCGTGTCCTCGCCGGAGATAGCTCGCCAAATTCTTCAAGTCCAAGATAACA
TCTTTGCTAACCGTCCCGCCACTATTGCCATCACCTACCTCACCTACGATCGTGTTGA
TATGGCGTTTGCCGACTACGGACCTTTCTGGCGTCAGATGCGTAAGCTTTGTGTGAT
GAAACTGTTCAGCCGGAAGCGGCGGAGTCGTGGGATTCCGTGAGGGATGAGGTGG
ATTCCATGGTGACCACCACCGCCACCAACTCCGGCTTGCCGGTAAACTTGGGGGAGC
TTGTATTCGGGTTGACCCATGATATTATTTATCGTGCGGCTTTCGGGTCGACGTCGCA
TGAAGGTAAAGAGGAGTTTATTAGGATCCTACAGGAATACACCAAGCTTTTGGTGC
ATTCAACTTGGCTGACTTTATCCCATGGCTCGGCTTCATTGACCCGGCTGGGTTGAAC
ACCCGTTTACCTGCGGCTCGAGCTGCGTTGGATGGGTTTATTGACAAATCATCGAC
CAACACTTGGCAAAAGAGAAAAAGGTCGGCGATGAAAATGTGGATAACGATATGGT
```

SEQUENCES

```
TGATGAGATGTTGGCGTTTTACAGCGAGGAAGGAAAAACCAACGAAGCCGAGGATT
TGCAGAACGCCATCAAGCTGACCCGAGATAACATCAAAGCCATAATCATGGTAAAT
TCTATAAACTCATTTTTTAATAATTATGAATGATAATTTATTAAATTTATTTTCTATTT
TAGTTTATTTTAAATAAGTATATTTACCTTTAATTATAAAATGGAATTACTTTATTAT
AATTATCATTTACTTAATTAAAAAGTATAATAATTACGTATTTATAAAATTATATGAT
GATATATGTTTGGGAGGAATGGGTATTTATTTACATCATCTTGTATTCTATTAAAAG
TAAAGAAAAGCTTTTGATTCATGGTAAATTATTACTAACACAAAAAATTACATCATT
TTGATGAAAATTTTGTTGAATTGTTTGCAGGACGTAATGTTTGGTGGTACAGAGACG
GTTGCTTCTGCGATTGAATGGCCATGACGGAGCTCATGCATACACCCGAAGCGCTC
AAGCTTGTGCAACAAGAGTTGACCAACGTTGTTGGTCTTGACCGTCGTGTCGAAGAG
TCCGACTTCGAGAAACTGCCCTACTTCAAATGTGTCATCAAGGAAACCCTTCGTCTG
CACCCTCCGATCCCCGTTCTGCTCCACCAATCGTCAGAAGCCACGGAGGTTTCCGGC
TACCACATCCCAAAAGGGACACGTGTCATGGTCAACTCCTACGCCATCAATCGTGAC
AAGAACGCTTGGACAGACCCTAATACTTTTAATCCATCTCGTTTTCTGCAAAACGGA
GCCCCAGATTTTCGGGGAAGCAACTACGAGTTTCTCCCATTTGGGTCGGGCCGAAGG
TCGTGCCCAGGAATGCAACTCGGGTTGTACGCAATGGAAATGGCAGTCGTGCACCTT
CTTCATTGTTTCAACTGGGAACTACCAGATGGAATGAAACCAAGTGAAATCGACATG
GGCGACGTGTTCGGGCTCACAGCCCCAAAGGCGATACGACTTGTAGCCGTGCCGAC
TCCTCGTCTGTTGTGTCCGTTGTATTAAAACTCTGGTTTTATAATATTATTTTTATAA
AATAATGTATAAGAAATATATATAAGAACCACAAAGATTTGATTCTATACCACTTGT
TCATAGGTCAAACCTAATTTGTGCATCTGTTTTTTTAATTGTATTTATGACTTTTTAAG
CAAAGAAATTTCAAAAGGTTGGCAAAATCATGCTTTCCCAAATTAAATATTTGAAAC
AAAATCTATGAGGGAGACATAGAAAAATGAGCACAAACATAATTGGAATTATTTAT
GTAATATAAAACTAAACACTTTTGAATAAATTTACAAGTACAAAGTTTAAATACCTA
GCTACGTATATAAATTTTAAATAAAGATACGAGAAATCATAATTTACGTTTTAAAAA
ATAATTGATGTAATATACACGATGTTAATAATGGAACGTGGGTGAAATTTAACGTGT
TGTATTCTTAAATTAGACGTACGGATTTTTAAGTACATGTTTTAAAAAAATAAATTTA
TATGATAAAACGTGTTTTAAAAGTGTAAATGGAACGAAAGTATGGTTATTATTGACG
TAATTAGTCAAAGTTATATATTTGTAATAAATTAATGATGATTTTCATATCTATTCAC
CACAATTTTTATATGCTAATTAAAAATAACATAATCGTTTACCACAAGAATACAAGT
TTGGGATCAATGTTTTCAACCACATGATGATGATGAGGATGATGTTGATGTTGATGT
TGATGTTGATGATGATGATGATAGGGATATTTGAAGTGAATGTTTCACTTGTGTAAT
GCCATTTTCCATGATGTTGTTGGGATGGTAATGTCATCCATGATCATCCATGTATAAT
ATATAAAATGTCATTTCTTTAACATTATAAATCTAGTTTTTTTTTCTAAATTTAATTG
AAATTTAAAATTTTTAATTCCCGACTTTTCTTTGAAACTAAAGATAAGATTGTAATGA
TATTTAATTTCAAATTCTATTAAATCTCACAAACTAGACGAGTTAGGGATCGTTTACT
TAAATACTTATCAAGTAAGAATTTATCGGTAAAATTAACACTATCATTTACTTACCG
GACAAGATTTATTCACTAAAACGCATCGTATGCAACAATTTATCGCGGTAAGCGCT
AACCATGGTAAGAGTCTTTGTCCTCACTTACTGGTTAAGACTCGAAATTCTTCTTTTC
GCTCTTACCGGGTAATATTCTTAGTCTTTGTCATATTCATTCGATAAAGTAAATTGCT
TTGGTAAGCGCTTACCCAAGTAAGCGTTTTGTAAACGGCACCTTAGTGTTTGTGGAT
TTATGACTTAAATCTCACAATCACGGGCAATTTCTCTCATGCTACACACACTTGTACA
TAAATTGATCGTGAAGGCAAGTTTCAGTGTTTTATGAGTTTTGATGTCGAGTTGACA
ATGTGTATGTCATGATAAACTTCCAATTAATTGTTCCTTACATTCGTTGTGTAAGATT
TAATATTTTTGAGATGTTTGATAACGAGTTTAGTCGTAGTAAGGCCCATCAATACAT
CAGTTTGGTCGATCACATTGTATATGTGTCACAAAGTAAGAAAGAAAACTCAAATCC
GAGTTTCATATTTCTATCTCGGCACATCTTTCATGCCAAATAATAAATGTAACTTAGG
CCTACAAAGCTATGTAAAGAATGACAAAAAAAACGAATAAAAACAAGCCTATTTCA
GTTTCGTAAATACAAATGTTACCACCATTTAATTTATTCAAGTTTTTGGAAAACAAA
AACCGTACATTGCATCCAAGATAAGCACATTTTCAATAACTTGTCATCTCACTACAA
CAAAATTGGGTTTATAGGACGCCCCCAATCTCGAAGTGTCCCAATAGACCGTTTTAT
AGAACTAAAATATAAAGTGTTCTATCTAAAGACGTTGTAATAAGTTTATATGACGCT
TTTGGACGTCTTAACAAGTTTTTGAGGACATTTTTAATACAAAGTGTCACATTAGCA
ACTTTATAGGACACTTTGA

SEQ ID No: 109
>Radish_GSRAST00026355001
TAAGAACTTGGAACAGACACAAACAAAGACATGAAGTTGGTAAGGTCAG
ACTATTAAGAGAATCAATATATTATTCGATTTAATCTATATTATTAAAATTGAAGTA
CAAATTAGATTTTTTGAAACGAATAACAGTTTTTTTTAAAAAAAAAATTGTTTAGA
AACATGGATAACAATTTTTAAAAGTATGTTTGGAAACATGAATATCAGTTTGAAAAA
GTTTGTTTAGAAACATGGATAAGAGTATTAAAAATAATATAACGTTGTTTGGAAACA
TGGATAGTAATATATTAAGAAAAAGTAACAAATTTTGTATTATTAAAAATACTGAA
AGTCTATTATATTATGATAAATTATCTATTTGGAAGAGTTTTAAAATATAAGAAAAT
GAGCTAATATAATTAACAATTTTTTTTTGTCTAAAATAATCATAAAACAAGATTAA
AATTTTATATACATATTTCAAATCAAAATAATAATTTACATTTGATTTATATCAAAAT
TGATTCAAAAATACATATATTCAAAAGCTTATTTTACTAAAATAGTTTCCACTAA
CCATTATAAAAAATATTTTCAATATATATAAGAAAAATACAATAAAAAGTCCATTAA
TTTCATTATACCAACTTAAATTATGGTTTTAATATTTCACATTAAGTTTTTAAAATAC
AATATATGTGATTATTTATATGATGGTATGTATTAAATACTATTAATTATATGATTAC
TTATATGATGATATATGAAATAAAATTAATTATATGATGACACAAATATGATATA
TAATAGTGATTAGGGGTTAGCGTTCGGATACCCATTCGGGTTCGGTTTGAATTTGTTT
GGATTTCTGGTTTCTGGGATCAACGATTTCAGTCTCATTTGGATATTTCTAAATTTTG
GTTCAGATTCAATTCAGATCTTTGCAGATTCGTATTTGATTCAAATCTTTGCGGGTTT
GGTTCGGATTCAGATAACCCATTTAAATTATTTTTCAATTTTTAGAATATTTTATACT
TTAAATTTCTCAAAATATGTAAATGAAATAATATATTACATATAAGTTTGAATAATA
TACCAAAGAAACTCATACTAATAGAGCGTTAACGATTGTGAGTTACACCATCCAGTT
```

SEQUENCES

```
TTGAGTTTTGACCATCGTCGTTAAAGTGAAGTGGAAAAATAGTTTTCTCGGATATTTT
TGAAAATTCTCCGATTTTAGTGGATCATTAGACGATAATCAAATCTCTTTCGAATAT
ATTCGGATACCAAGATCATTAAAAACTCATGCTTTTAATATACAGATTTTCTATTCTA
AACACCAAAAACGTAAAGAATATAATGTCTCCAAGAATATAACTTCAAGTTTATATA
TTAATATACTTTTAATATACATTTAATAGTACATTTTTTATTGTGTGCAAAATAACCT
TGCATGTAACAATAAAAGTAAGGGAACCTTGTTAGTCTATCAGTCTATTTCTAATGT
CTAAGCTTTAGAGCTATTAATTGATATTAATAATTTATCTAGACCTTGTGCTCTGTGG
ATATCTTTAGTAATGTTGGAAAGTAGAAAAATTACAATTGTTTTACACACTTGTATA
AATATAGCTGTCGAAGTCGCGGTAATTCTTATAACTAATTGTTTCAAATTATTATGTT
ATTGATGGAAAAGTATATTTATTCAACCTATTTATTCTAGGTAAAACCAAGCAGTAC
TCGTTAATATTTCAACAGCATTTTTTGTAACTCACCTTTTCTCTAATTTAAAATCCACT
AATACCAATAATGATCCATTATATTTCTATATATGCAAGAATATCCATTAAAACCAG
TCAGTATATTATTTGTTTCCATATTAAACAAAATAATAGTAATAATTAAAAAGGAGG
TGTATGTATAATTGTATACATATATATGAGTCACGGAAATGAAAATCCCCGTAGAAA
ATTAGAAATATGTCAAGAAATGGGACCACTCCTTGATTATAAAACCTACCTTTCGTA
ACACATCCCAAAATGGCGAACTTTGCCTGATCAATTCTTGAGACCCTCCACAAACAA
AAGAAAAAGCATTTCCCAAAAAGAAAAAGAGACTAAATGGAGTCTTCTATATCACA
AACACTAGGCCAAGTATTAGATCCCACCACGGGTATTCTCATAGTCGTCTCAATTTT
CATCTTCATTGGCCTCATCACACGGCGACGAAGGCCTCCGTACCCACCCGGTCCACG
TGGTTGGCCCATCATAGGCAATATGTCAATGATGGACCAACTCACCCACCGTGGTTT
AGCCAACCTAGCTAAAAAGTACGGTGGCTTGTGCCATCTCCGCATGGGATTTCTCCA
CATGTACGCCGTTTCATCACCAGACGTGGCTAAACAAGTCCTTCAAGTCAAGACAG
CGTCTTCTCAAACCGACCAGCAACTATAGCTATAAGCTATTTGACTTATGACCGAGC
CGACATGGCGTTTGCCCACTACGGACCGTTTTGGAGACAGATGAGGAAAGTTTGTGT
CATGAAGGTGTTTAGCCGTAAACGAGCCGAGTCATGGGCTTCTGTTCGTGATGAGGT
GGACAAAATGATCCGCTCTGTTTCTAATAACGTTGGTAAGTTCGCTCGCGTATTTAC
ACTCGCTATCTGCAGTTGAATATTTAAAAATGAATAATCATTTTTGTTAGTTTATTAT
GCATTTGTTTTCTTTGATATATGTATTTTAATAGTCAACCAAAAAAATTGTAGGCAAG
TCTATCAACGTTGGGGAGCAAATTTTCGCCCTGACCCGAAACATAACTTACCGGGCA
GCCTTCGGGTCAGCTTGCGAAAAGGGACAAGACGAGTTCATAAGGATCTTACAAGA
GTTCTCTAAGCTTTTTGGAGCCTTCAACGTAGCGGATTTCATACCTTATTTGGGTGG
ATCGATCCACAAGGAATAAACAAGCGGCTCGTGAAGGCCCGTAATGACCTAGACGG
GTTTATTGACGATATCATCGATGAACACATGAAGAAGAAAGAGAATCAAACACAG
CTGATGATGGAGAAGTTGTTGATACCGATATGGTTGATGATCTTCTTGCTTTTTACAG
TGAAGAGGCGAAACTAGTGAGCGAGGCAACAGAACTTCAGAACTCCATTAAACTTA
CCCGTGACAATATCAAAGCAATCATCATGGTAAATATTTTTCCCGAGGCACTAGTAA
TAGTCATTATTCTTAATGCGTCGTTACGTCATAAAACTTATCTCATTTAACTGGCTGTT
TTTCTCTTAAAGTATATATTTTCTGTTTCTACAAGTAGTCAATTGATAGTAGAAAAAT
ACAAAGGTTTCATATCATACGTAAATAAAATAACTGCAAATATCATAACGTCATGTG
AATTGACTTTTTTTTTTAAATAGGACGTTATGTTTGGAGGAACGGAAACGGTAGCGT
CAGCGATAGAGTGGGCATTAACTGAGTTATTACGGAGCCCCGAGGATCTAAAACGA
GTTCAACAAGAACTCGCTGAAGTAGTCGGACTTGACAGACATGTGGAAGAATCAGA
CATCGAGAAGTTGACTTTTCTGAAATGCACACTCAAAGAAACCCTAAGGCTCCACCC
ACCGATCCCACTCCTCCTCCACGAAACCGCAGAGGACACTGAGATCGACGGTTACTT
CGTTCCCAAGAAATCTCGCGTTATGATCAACGCGTTTGCGATTGGACGCGACAAGAA
CTCTTGGGTCGACCCCGAAACGTTTAGACCATCTAGGTTTTTGGAACCGGGCGTACC
AGATTTCAAAGGGAGTAACTTCGAGTTTATACCATTCGGGTCGGGTCGTAGATCATG
CCCGGGTATGCAACTCGGGTTATACGCACTTGAACTAGCCGTGGCCCATATATTCA
TTGCTTCACGTGGAAATTACCTGATGGCATGAAACCAAGCGAGCTTGATATGAGCGA
CGTGTTTGGTCTGACGGCTCCTAAAGCCACGCGTCTCTACGCTGTCCCGAGCACGCG
CCTTATTTGTGCTGTTTAAAGTAATGGTTCGAAGCACGTGGACGGTGAAAGGAAAGG
TGGTTGGTATGGTTCTTGGAAGTGGTGTGAGAACTCAAAAGAAGCCCTGAAGATTTG
TGGATGTTATATAATACTATATGTTTATGTATTTGTGTACTAATGAATTAAAGTTATG
TATCACGTGTGTTCTGGATGAAACATAAAGTGGCTCTTTGTTTCGTCTTTCATTTTCT
TTTGGGAAATATTTTCCTTGCATGAAATGTAAACACTGAAAAATAAGATTTTTTTAC
AACTAATTTGCATATTACAAAAAAGTATACTAATGAATTAATGATATAAGGATATTG
CATTTGCTGGAAATGTTAAAACATAGGCATTTCCATCACTGTGAGCCACACATGAGT
TTGGCAACCGGTGAACTAAGTGAATATTCATCAATTTTAAGATTTGAGAAACCTAAT
GTAGAGAATATGGAGATGATAACTTGTAATTTTATCCTAAATTTTCGTTACATTATA
ATGATAATGCTAGTTGTCAATTAATTAATTGTTATATAAGAAGAGTTTTGTTAAAAG
AACGAGTTTCACAGTGGAAGTTTTATTGTACATATTTTCTTGTTTTATTTGATTTTGGT
AACGCCCGTCTTCTTTATTGAAAATATTTATATTTTCCTTTATATCATTAGTATGGAA
AAATATTGTAGTCTTTATCGAAACGCATCTATTTTACCTGAACTAGAAAATTCTGAC
CATTATGTCATAGACCCTTCATTTGGACGCTGTTGGGACTAAACTAATACTCTCTCCG
TTTCATATTATTTATCATTCTAAGTTTATGCACACAAATTAAGAAAATATTTAATTTT
GCATATTTTCAAAATAAAAGCATTATCAACAATACATCTAACCATATATCAACTAAT
AAAAAATAAAATAGAGAATATTTTCAATAAATTTTGCATTGAAAACCGAAAACGAA
ACTTATTTTTAAACGAAAATTCTAAAACGACAAATAATTCCAAACGGATGGAGTATT
ATATTTGTTAATTGAAAAAATCACTTATACATGTATGTGTTGATTATCTAGGGGTTGA
CTGTGGAAACACAATTTTTGTGATTAATAACGGTTGTTTCCAAATCGTTTCAAACCAT
TCAAAATCTCTTAAAATCAAAGGTTAGTTTCTGAATTACGGACAGTTATGGTTGAAT
AAATAAATAAAAAAATTTAAATTTTTTTTTTTAAACTTTAACTTAAATTTTAAAATGA
AGATATTATGTATAAAATATACATAAACATTTATTTTTAGCTTAAATCATAAACAGT
ATCATAATTTATTTTATAAAAACTTTAAACTAAGAACATTCACTATAATTTTTAAATA
TTAATATATACATATAAAAGGATATGTTCATATATAAACGAAACAAATATTTATTT
TAAAAGTTTTAATAAAAATCTTCAAAATAAATTTCATTGAAATTATAACTTTTATTTA
AATTAAAAAATTAAATTATCATGTATTGTTAATAATTATACTATATTAATAATTAATA
```

SEQUENCES

```
TATTTTATCATATAAGTGTGTTTCTGATATTTTTATAATGTTATATATGTTAATATTGG
TAATTTATTATTAAATCTATACGATAAATCATAAAAATCAGTTATAAATATTTAGTG
AACACGATAATTTTCAAACATTGTACCAGTCATATAAAATTTTATATGATTAGTTAC
ATTTGAAATGGTAACTATCTATATTCACAAATTTCTGTATCCACAAACTCATACATCC
AACCACAATCGCTGCATTTGAATCCGTAAGATCCTTAGTTTAACAATATAGATAGAT
ATCAAAATCTAATTCATGCATCCAATCACAATCGCTGCTTTTAAACCAGTGAGACCT
TTAATTTTAACAATATAGACGATCAGATTTCTAGATAGATTTCTAGGTAGATGTCAA
AATTGTATCTAAACTACTCACTTGCAAAATTGTAACAACCAGAATGCATCAAGCAGT
GATCGATCCCAACTTCAACTACTTTGACGAAATCAATAAATTACAATTACTTAGTCT
ATTTTCCGTAGCTACACGTAGCGCGTCCATGCGTGGACTATTGCATATCACAAAATA
ATTGCATATAATATCATCATTATCAGTATTTAATGTCCGAGAAAAAAATTCAACGAT
ACAGAAAATTTCTAGTATAAATTATAAACAAAGTCTCTAAAAACTAGCGGTGCCTCC
TTGACATAAACATTTTTTCAGTGGTG

SEQ ID No: 110
>Radish_GSRAST00007419001
TATTGTTTATTAACATTTGTATATTTCTTATAACAATAAATTTAAACCGTTA
ATCCTAAAATTTTCAATGTGATATTTTTAATGCAAATTTCAAAATTAACATATTTATT
TATTTTTATATTGTACATAGTTTAATTTAAACTAATATGTATATAATATGAATATATA
TTAAATGAGAATTCATATTGAACTACTTTCTTTAAAACATATTGAATGAAATCATTA
CACCGTCCACCTTAAGGCACAACAATATATCACTGTATTAACTCAAATACATAATTT
TTGTGATTCCTCTTATACGAAAGGGTCAAAATATGAAATCATGAATCTTTGCACCTT
GTAATATGAAATCAAACAAAAAAACGTTTCCCAATTAATATATATGGGATTAGAG
TAATCATATAAATCAATATATTATCTCTTGTTTATTTACAATTTTTTATGGTAAATAT
ATCAGAATAACTATTTTATTTGATTGGGTCAGATGAGAACTATCTCAATAGTAAGAT
CACCAACCTAAGAGTATTGCTTCCACAGTTGAATGATTTTGACATTGATCTCCCACCT
AAACTTGAATGGTTTCAAGTCTGAAACGGGGGAGGGGAGTAAAAGAGGACACCG
AACGTGTTCTAAGAAATCTATGTGGACCACTCACATGTTTTTTTATGTGTTGACCTT
CTAGCAAACCAAAACAACCTTCTTATATAGTGATTTGTTCTTATTTTTGTTTACAAAT
CAGAATGATCGTAAGCTTTATACCAGCTTCCCATAAATAATACTCCACAATGACTAT
ATGGAAAACTGAATATAAATTAGCAATTTTCGTGTATCCGTAAAACTCATTATAGGA
AAGTAATGATCTCGTGAATATATTCTCTAGTTAATGTGTTGCTAACAATGCGCGATG
TATATTCTTTGATTGACTCTTCAAAAATTAAGTTAATGTGACAGTGAACTTGGTGGTA
TTTATATAGAAGCGCATTTTAGGAATGCTTTTAATTTGCCTTTGACTAACTAAAACCT
GTATCATTAGCAAGTTAGTGAAATTAGGCATATACAAAATAATGATACATACAAAA
CCGTTCAAAATTCCATCTACAATTCTACATATAAAGAAAAATTCAGAATGTACCTTC
AGGTGAGCATGGCAATACAGAATTATTATACCCTACATAGAAAAAGAAAAACCACA
TTAAATATATTTAAAGATTAGTTTTACGAAACTATCAGTAAAATATCAAAACATGAT
CATAAAGATACAAATGTATATTTTAACTCTATAGTCCTCACTCCTCAATGACTATATG
GAAGAAAAAAGGAAAAAAAATAGAGGCTTCTCTATAGAAAATTTAATGGTTATGTT
CAAATGTATTATCGATAGAGAAAGAATAAAATTTAAAACTATATAATAAACCTCTTG
TATCAAAATACTATGATCCAACTCAATAAACCACAATGACTCAAACATCAGCAAAG
AAATAAAGTTTGGTTTTTCTATAAAAATAATAATGGTTACATAGAAATACATCGTCG
AGTGAAAATTCATGGTCAAAATTAATTTGTTTATAGATACAAAACCATAAAATAGAC
CCTATAATATATTTCGAAAGTACAACCGGACTCAATAATCCACTATGTCTAAAAATC
CTTATAGTAAACTATGTAATAATATGTTTCCGAAAATGGTTGGAATCTTTAGACACA
AGTAATAATATATTTATGACTAAACGTTCTAACACATAACGTTACGTATCATAGTG
GGTTACATTGAGTTATCCAAAGGACAATTGAATAATATATATTCAATGGCATAATAT
CGTAAATACTCTAGTAATTTATGTCTACTTCTATAAAAGGGCTGAGAATGCTTGTGA
AGATGCCACATCAGTAATGGCATTTTTGTTAATCATACATCAAGCAAAGGTTAATTA
TTAAAAGTGCTCCTCAAATAATAAGAAAGGGATCACACTTAGAAATATGTCAATAA
ATGGGACCACACTTTGATTATAAAACCCACCTCTCTAATCACATCCCAAAATGGCGA
ACTTTGCCTAGACCTCTTACAAAGAAAAAAGAAAAGAAAAATCAGTATGGAGTCTT
CTGTATCACAAACACTAAGTCAAGTATTCGATCCCACGACGACTATTCTCATCGTCG
TCTCCGTTTTCATATTCATCGACCTCATCACACGACGGCGAAGGTCTTACCCACCCG
GTCCACGTGGATGGCCCATCATAGGCAATATGTTAATGATGGATCAACTCACCCACC
GTGGTTTAGCAAACTTAGCTAAGAAATACGGCGGCTTGTGCCATCTCCGCATGGGCT
TCCTTCATATGTATGCCGTCTCATCACCTGATGTAGCTCGACAAGTCCTCCAAGTCCA
AGACAGCATCTTCTCGAACCGGCCGGCAACGATAGCTATTAGTTATTTGACTTATGA
CCCGAGCCGACATGGCGTTCGCTCACTACGGACCGTTTTGGAGACAGATGAGGAAAG
TGTGTGTCATGAAGGTGTTTAGCCGTAAACGTGCCGAGTCATGGGCTTCTGTTCGAG
ATGAAGTGGACAAAATGATCCGGTCGGTATCTAGTAACGTTGGTAAGTTAGTTATAT
GCGGCTAAATATGTAAAAACTAAAAACAACAAACATTTTTCTCTCTTTTATACGTAT
TTTAACAGGCAAGCCAAAATAAATTGTAGGTAAGTCAATAAACGTCGGGGAGCAAA
TTTTCGCCCTGACCCGAAACATAACTTACCGAGCAGCGTTCGGGTCAGCTTGTGAAA
AGGGACAAGACGAGTTCATAAGAATCTTACAAGAGTTCTCTAAGCTTTTTGGAGCCT
TCAACGTAGCGGATTTCATACCATATTTTGGGTGGATCGATCCACAAGGGATAAACA
AGCGGCTCGTGAAGGCCCGTAATGATCTAGACGGATTTATTGACGATATCATCGATG
AACATATGAAGAAGAAAGAGAATCAAAACACTGTTGATGATGGAGATGTTGATACC
GACATGGTTGATGATCTTCTTGCTTTTTACAGCGAAGAGGCCAAATTAGTGAGCGAG
ACAACGATCTCCAGAATTCTATCAAACTTACCCGTGACAATATCAAAGCAATCATC
ATGGTATTTTTTTTTCAAAAGACCACTAGGCATAGTCATTATTATTAGTGCGTCACA
CCACAGAAGTGATATCCATCTCAAACCACTAGTTTCATATTTTTGTCTAAATCAGGA
AGGTAGCTTTCTGTATTTACAAGTAGTCCATATGAATTAGAGATCTTGAGTAAGCAT
TAGGGGAAATGACGTCATTTACTGATAGTAAGAACTCTAGAATATTAAATTTCGAAA
AAGACCTAAAATACAAAACATGCAAAAAATATGTACAAAGGTAATATAAATCACAC
GTAAATATAAACTGACCGTCTTTGAGCTAACAATTTATTTATTTTAACACTTTAAAAC
```

SEQUENCES

TTAATTTGAAATTTGATATAAAATAAACCTAATTTGAATTGATTTTTTGAATTTAATA
GGACGTTATGTTCGGCGGAACGGAAACGGTAGCGTCGGCAATAGAGTGGGCCTTAA
CGGAGTTATTACGGAGCCCCGAGGATCTAAAACGGGTCCAACAAGAACTCGCCGAA
GTTGTCGGACTTGACCGGCATGTGGAAGAATCAGACATCGAGAAGTTGACTTTTCTG
AAGTGCACACTCAAAGAAACCCTAAGGCTACACCCACCTATCCCACTCCTCCTCCAC
GAAACCGCCGAGGACACTGAGATCGACGGTTACTTCGTTCCCAAGAAGTCACGCGT
TATGATCAACGCGTTTGCGATTGGACGTGACCCTAAGTCTTGGCCTGACGCCGAAAC
GTTTAGACCGTCGAGGTTTTTAGAACCGGGAGTAGCGGATTTTAAAGGAAGTAACTT
CGAGTTTATACCATTCGGGTCGGGTCGTAGATCGTGCCCGGGTATGCAACTCGGGTT
ATACGCGCTTGAGTTAGCCGTTGCTCATATATTACATTGCTTCACATGGAAATTACCT
GATGGGATGAAACCGAGCGAGCTTGACATGAACGACGTGTTTGGCCTCACGGCTCC
TAGAGCCACTCGTCTTTTCGCCGTGCCTAGCACACGCCTGATTTGTGCTGTTTAAGTT
ATGGTTCGTAGCACGTGGCGGGTGTAACCCAACGAAAGGTTTGTATGGGTGTGAGA
AGTCAAATGTAGCACTGAACATTTGTGGATGTTATTATATGTGTGAATGTGTATCAC
GTGTCGTCTGGATGAAAACATTAATGCTCTTTTTCGATTTTCCTTTTCTTTTGTTGGGA
TTTTTCCTTGAATGAAATGTAACTGGTAAAATAAAGTTTTTTTCTACAATTACCTT
TGCATATTACGTAGGTAAACAAACTATTAAGAGTGCATTTGTCAGAAATTTTATAGC
CTAGGCTCAGATTTCCATCACTATGAGTCTATGACTTACAAGAGTTTGGCAACATGT
AAAACCAAGTCGCTTTTCAAAAAAAAAAAAACATGTAAAACCAAGTTAAAAGCTCA
ATTTTAGATATGAAGAAGCTGCTATATAGCCTTTAGTCAAAAAAAAAAAAAAAAAG
AAGCTGCTATATAGGGCAAGTTGGAAATCATAACTTGAATTTTAAATTTTAGTTATT
GTTTGTCACTTCTCAGTTTATATGCATGTTAAAAAGCCAAATCACCTTAGTTATTAAA
CGAACTAGTCACTTGTAAAATATTTTATATATTATCACTACACCTACCTTGACGAAA
GCAATAAATTACAAATCACTTAAATACGTTAGATTTGTAGTCGATATACACACGTAG
CACATTCATATACATACATACGTACGTATGTATCATACGTGGACTATCGAATATCAC
AAAATAATTGCGTATATCGGTATATGTATTATTCTCAGTATTGAATATGTCACAAGC
AAAATATATAACCAATACAGAAAATTTAGAAAAGATAATTATTGCCAGTAACTAAC
AAACAAGCGGTGCCTCCTTGACATACATTTTGTGTGTGTTGGAAGCTTACGAAAA
CGACGATTTTACAGACAAGCAATGTGTTGGGAAGAATTGAATAGATACCGTAAAAG
TAGCTCTAAGCCAAACTATTGTTGAAGCTTAACTATCTAAGTGACATATTTGCAAAC
AGTGGCGGAGCCAATGTATTGGTAAATGGATCAATTGACCCATGTGAATTTCTTATT
TTAATTTCGTTTACTTGTATAATTCTTTAAAATCAAGATTATTATTGCAAATTTTAGC
TAAATAATCTCTATGATCTATGTTAACTTCAGAGTTGACTCGCCTAAAAAGTTTTCTT
AGCTCCTCCACTATCTTCAAAGAGGTTGGTTCGAGTAGGGCTTGTCTTTGTCTTCTAG
AGAAGCCAGCTTCTCGACCCATCAACCATTCAAGTCATACTGTTTCATTTTTTTAGAG
AAGCCAGCTTCTCCTTGACCTTGCGCTTAAATTTTGGCCTTTATTTTTTTCATAAATA
GTTTTACTTCTGATTGTAGGGACAATTCAGTCAGGCGACCCCATTTCCTTTCATTGGT
ATGGATACTTTAAAAAAATGCAGTGATGAGGGGATTGGAATAGATCTATATAACAG
TTGAGGTTGAGCAATGCATGCATGGTTATAATTGTAATAGAAGAACATAACTTGACA
CCCTCGTAAATGAGACAGAAGCGCTGTTTAAAAACATTGTTACTACTAACTTATGGA
GTTATTTTTAGTTATTTTAACATGGTAACACGATTAAAAGAGAAATTAATCGGACCT
CAAAGAAAAAAGTCTTCTTTCAGACATAAATACAAACATCAGAATCCACATTTTCAT
TTTTCCTTTTCGACTTTTTTTTTGTAATTTAACCTTTTCTACTTTTTGAGTAGAAAAGG
ACACGAGAATAGTAGCTATGAAAGACCAGCATGGTCAGAGAAAACGGTAATATGTG
GTGGTGGACTCCGCACGACGGCGTTTCAAAACAATAACAACGCATAAGTTGTCGTCT
TTCACCGGCGTCGAACGTTCAGACAAAGACGATGACAATTAACAAACAAACAAAAT
AAAAGAAACCCTTAATGTCTACGTACAGTTAATAACGACGCTTTTTTTGTTGTCGTC
TGTAATTCAGAACATGTGAACAGGATAAAAATAAATGCGAAGACAGAAGGTCCTAT
TATTTGTATCATATACGAATCTGTTAGGATCTCCACATCTTTGAGTTTATAAATGGAAT
ATAAACAATATGAAGAGAGATCTAATGATTGTCAAATTTTGAGTCTGAATTGCTTAC
ATAAAATCACCATACCTACGTTTGTCGAT

SEQ ID No: 111
>Radish_GSRAST00001088001
CAGATTCACCATGGCCAAAGAACAAATGAAACATTAAGAAAGAACTCAG
ATTTTTGGCATCTAAGAACACAAAGAGAGTCAAGAACAAAGATGAAACTTTGTCCA
TCACAATTTACACAGATACAAATTAGGGCATATAAAAATATGTTTAGATCGAAATAA
ACGAGGAGAGAATTTGGTACCTCTCGAGTAACTCGCGGAAGGAGTAGAGAGAAG
AGAAGGGTCGGGTCTTTTCCACCGTCTGCTCGTTCTCAGATCTATTAAAAAAACAAA
CATATCAATATAAATAGGAAGAAGAGGAGGAAGACGAAGGTCACGAAGCCAAAGA
GGAGGAAGACGAAGAGATGTCGACCCGTGGTGATGGTGAGGAGGTGAAACCGGTG
AGGAGATGGAGAAATGAGTTGATTGTTACGGAGAAAGAGATAGATTGGAAGAAGA
ACATTGGAAGAAGAACAATCCAACGAAGGAGAGAGGGAAAAAGAACAAGAAAAG
AAGAAAGAAACAAAAAAAAACAAAAAGAGATTTAATCTGGACCCTTCATAATTTTA
ATCTAATGGTTAATATTGTCAATCCACGCAGCTCATTCTTATTGGTTAAGAACAGAG
AGGTTTGGAGAAATAAAAATACAGAAATAAAAAAATCTGTGTTTTATTTATGTTGT
TTAGCTATTATTAATGTCTATATTTTTTTAAAAAAATAGTTTATCTTTTTAAAACAG
TGTATGATTCTTCATATACTTTGATCATTTATTTTATAAGAAATGGTTAGATTTAAA
TGTAAGAGTTTATGGTTTTGTATGTAAGTTTAAGTTTGGGGTTTAGGGTTTGAAGTAT
GATATAGGATTTGAGTTTATATGATATATGGTTTGAGATAAAAATTTGAAATGTTCT
ATATAGCTTGAAATGTTGTATATAGTGAGAAATATATTTATCTTATAGGAATTGATTT
TATTTAAAATATAAGATTTCATGTTTTATGAAATAGATTAATTTTGAAGTATGTGGTT
TATAGTTAAGATATGTAATTAAGTATATGATTTGATTTTTTAAAAATATTGAGTTTA
TAGTTTTATATTTAAGATTTTGAATTCATATAAGTTTGAAATATTAAGTTTGTAGAG
TGATTGTTATAAATATATGTTTGTAAGTTTATGGTTTAATGTGTTTAAAGTGATGAAGG
TTATATATATATATGTGGTATGAGGTTAATTTTTTAAAATCTGAAAGTTGTAAATAA
GTGTTGGATATTAGATAAAGTTAAACTAGGTAAATATTAATTAGATATATTGTTTTG -continued

SEQUENCES

TAAATATATTTAAGTTTAGGATATATATTTGGGGTTTAGGGTATAAATCGACATAGC
CATGGAAAAATAGTGGCTATACAGTGGCTAACGCTCTTACCACAGAAATAAATGTG
GCTAAATCGTGGCTATGATTTAACATAAAAAAAATTATTTACTTTCGAAAATGCTTT
AACCGGGAAAATGTAAAAAATGTAAGCGGGAATAAAAAATCCAGTGGCTATATATC
TAGCCACTATAATATTTGGTGGCAATACAGTGGCTTTTTATCTAGCCACGATAAAAT
TCAGTGGCTACTATCGTGGCTAATTGACTTTACCGTGGCTAACTGAAAATCGTACCT
ATTTTGTGGCGGAATCGTGGCTTTTTTAATTTAGCCACGTTTTTGGAGTGGCACTACC
GAGGCTATGCGGAAGATTTCTACTAGTGATAATCACAAAATGTTCACACGAAATGA
CAACAAAACAATATATCCATACATATACTAGGGCAGTATTATTTTTGTATATATGAT
CTACCACAAAGTTGTTCATTTTGCAAAAGTCAACTCATTGTTTTATATAAAAGTCCAC
TCTTTGAAAGTTTTTATTTTGTTTAGATGATAAAAATATACTCATCAATGGGGCCAAG
TTATGGTTATAAAATCTAGCGCTGGCCTTAATAATCACATCATCTCAGATTAGTTGA
CACTTGACAGACTAATAATGGAGTCTCTATTATCACAAAATCTAAACCATGTAATAG
ATCCCATACCGTCAGCTCTTCTCATCACCATCTCTCTTCTAGTTGTAGTCTACCTCAT
CTCACAATGGCTTAAACCGCTCTACCCTCCCGGTCCCAAAGGCTTACCGGTAATTGG
AAATATGCTAATGGTGAACCAACTCACACACCATGGTCTAGCCAAGCTAGCCAATC
GATACGGCGGCTTGTTCCATTTACGAATGGGATTTCGTCACGTGTTTGCCATCACATC
ACCTGACGTGGCCCGACAAGTCCTCCAAGTACAAGACATCAGCTTCTCAAACCGGC
CCGTGACTGTAGCCATAAACTACTTAACCTACGATCTAGCCGACATGGCCTTCGCTC
CTTACGGACCCTTTTGGAGACAGATGAGGAAAGTGTGCGTCATGCAAGGTGTTTAGCC
GGAAACGGGCCGAGTCATGGGCATCGGTCCGTGAAGAAGTAAACAATATGGTCCGG
TCTTTGTCTAGCAACGACGTCGGTAAGCCCGTAAACGTTGGAGACCTCATTTTCACA
TTGACACGGAACATAACGTACCGAGCGGCGTTTGGTGCGGCCTGTGAGACAGAACA
AGACGAGTTCATAAGGATCTTGCAAGAGTTCTCTAAGCTATTTGGAGCATTTAACAT
CGCGGATTTCATACCGTTCCTAGGCTGGTTGGATCTTCAAGGGATAAACAAGAGGCT
TGTTAAGGCACGTAATGATCTTGACGGGTTCATCGATGAAGTTATCGATGAGCATAT
GAAGAAGAGGGAGACTATAAACGGTGATGAAGATACAGATATGGTGGATGATCTAC
TTGCCTTTTATAGCGAGGATTCATCACCTAATCGTAGCAAAAACGCCGTAAAACTCA
CGCGTGATAATATCAAAGCCCTCGTCATGGTAAGCCAAAACGTTAACCTTTTTTATC
TATATGATTTTCCTCTTAGTAATCATTTATTCCGTTAACATTTCTATAAATAAACAAC
TAGATAATTTAGTTGTAACGATATTTCAGCCAAATTTTAAATTTGAAAACCAATTTC
GACCAATTTAATTACTAAAAGAATTTTTGAAGTTGATGGTTTATATATTGGGATGAA
TGATAGTTTCGAATAATATTAATTAGTAGCAATTATGTATTACCGTTCTTGTTTGTGT
ATACAATACCATTTGGTTTTGGAAGTGATATTTATCTTTGTGTTACACTGTTAGGAA
TCATACATTTGATATGAGATGGAATATAAAGTAGTACACAATAGATATTGTTATATT
TCAGTTGATTATGAATTTGAAATTCATAAATTTTTTGGACGTTTTGATAACTAAAAT
AAATGGTAGCTCGATATATATTAATTTACTTTTTTTTTAACTTTTATTAATTTACTTTC
TTATTACTGGAAGGATGTTATGTTTGGAGGAACGGAGACGATGGCGTCAGGGATCG
AATGGGCTTTGACAGAGCTACTACGTAACCCAGCTGAACTCAAACGGCTCCAACAA
GAACTCACCGAGGTCGTGGGTCTTGACCAGCGCGTGGATGATACTCACCTGGAGAA
ACTAACGTTCCTAAAATGCACACTCAAAGAAACCATGAGACTCCACCCACCCATCCC
ACTCATCCTCCACGAGGCTATCGAGGACACAAAGCTCCAAGGCTTCTCTGTTCCCAA
AGGCTCACGCTTGATGATAAACGCCTTCGCCATCGCGCGTGACCCGAAGTTGTGGGT
TGACCCGGAAACGTTTCGGCCTTGTAGGTTTATGGAACCGGGTATGCCTGATTTCAT
GGGGACTAACTTCGAGTTTATACCGTTCGGGGCGGGTCGGAGATCGTGTCCGGGAAT
GCAGCTTGGGCTTTATGCGATGGAGGTGGCTGTGGCTAACATCATTCACTGTTTCAC
GTGGAAGTTGCCTGATGGGATGAAACCTAGTGAGCTCGATATGAGCGACGTCATGG
GTCTTACCGCCCCGAGAGCAACGCGCTTGATCGCAGTGCCTGACACGCGCCTCATAT
GCTCTGTTTGGCCCTGACCATGGAGAGAGAGGCCTTGTTGTTCTGTTCAGGATTAAT
GGTGCAAAAGCTTTCGTCTTCTTTTTTTAAAATTTAAACTATGTTTTTCTTTTTCACTTC
GTTTTTCTGTTCCCAAGGGACTTTTCTTCCTCAAAATGTATATGTAAATAAATGTTGT
ACAGGAAGACCAACGTACAAAACGTAAACAATGTTGTGTGCAGCCAAAAAAAATAT
CACGAAGAAACATTTGATCATATCTTCTTCTTATGCGCCGCTCTTTTCTTTCTTTCTGA
TGATCAGACAATCTCTGGACACTGGATGATGTATGGTATAATGTGTGCCCGCCCTGG
TTATGATTCTCTCCGGTTGAACCGTGCCCACAGCTAATTGTTAGTTCTTGAAAGCATT
TGTGGAGCTCATAGAGTCACCTTTGCTTACATCAAGTAAAAGGCTATGCCCTTCAAC
GGGACTGAAGCTAACGTTAATGGAGTGGTGGATTGATAATTCTCGAGGGCCACGGA
ATGTTGAAGTTGGAGAAGGAAGACGTTTTTGGCACTCCATGGCTTCGACTTCCGCCA
AAAGATCTGAGACTGACTCGTCACATTCGTCAGGTCCAGTCACAATGGGTTGCCAAT
CCGTGGTATCATTAGAGGCAAAGTTGAGTTTGAAGGTTGGACTAAAGACATCTAGG
AAGTCTATTTCTTGGTTGTCTGTAAACGACACCAAACCAGAGGTGTTCGAATCCCAC
ACATTTCCACTTCTGTTGCAGGCTGAGCTCTTTGTGATGATACTGTTACTGCTAGTTA
TAACACTCTGGTCAGTACACACTGAGTTGGAGCTAAAGTCAAGTACTCTACTCTCTA
GTTTAGTAACAGCCACGCTCCTGTTTTGATCGTTAGCTATAGTAATTGTCTCTTCCTG
CTTCAAGTCATCGATTGGTGTATTATTGGAGAGAGCAGCAGACTTTACAACGTCATG
GTTTCTGCTATCGGAACTGGAAGGTCTAAACTAAAACAAAATTTTTTTTGTCAAAAA
CGTTATATGCATGGGTATATTATAGATATATGAATTATTTTTATTGTCAAAAATAAA
ACAAAAAATTGGTAAATGGTAATCCTATCTAATTCTTGAGACCACATCCTTCAATC
AGAGTTTTGCAGATTCACTCGACTGATCGATGTGACATGAGCTACCTCACTAGAATG
TCATTGTTAAATAAAGTCTCAAAATACTGCATCAAGTATTCAGGTTATCCTTCACATT
CCGTATAAATTCAAAACTACAGCTAGTTCTTGAACTAACGCACCAGTTTTGCTTCTTG
TGTTCAGATTTGACTAGTGTATTAATGTGTGTTAACTCAGATTTACCATGAAATGTGA
AATGTGTTTGAAGACTCACCTTGGAAGCTATATTGAACTTCTCTTTGGTTTTGGAGTC
ACCAAGCAGCTCCAGCAGTTACGTACGTATTTAGGAAGCAGAATACTTCCGCAGCTA
AAACTCATTGTCCACATTTCTCGGAAAAATAAAAACAAAACAAAACATAGCAGTGA
CTTGTATCTATTGCTTAGACTTTAGGCGTGAATCAGAGTGGAGTTGGGATTAATGTA
TATTTTTAACACTTACAAGAAAGCAGGCTTGAGAAATTTCACACAGAATGATAATAC

SEQUENCES

AAGTCAGAGTCAGTACCAGGGATGTGTTATTATGAAGTCATAAAGAAGAAATTGAG
ATAATACAATATCTTGTTTTATGTTTTTGCTTGTATCAAAAATCATGCAGAATTAAAA
CCACAATAGCAAAAGCTTTTTTTATTATTCTTCTATCTTCTTCATCTTTGGTCAAGA
AGACAAGTAAAAAAAAAAGCTGGTAACTTTTGATACATGATAGCCTTTGGAGGAG
ATCAAGCAGTTCTCTTAATGATATGGACTCCACTGTCTGTATCCACAATCTCGCTTAT
ATCACCAACCTTGAGTGCGTATGTTGCCTCCTCAAACGGTTTCTGCATTTGACCTCTC
CCAAACGGACCT

SEQ ID No: 112
>Radish_GSRAST00042054001
CAAATTGCTCAATATTAATATTTCTTAATTTTTACTATATTTTTCTTTAGAA
AATGTTTATAAAAATTCGTTAAAGAATCTATATAATATTTTTAAATACACTAAACAT
CATTTGTTTTCTATGACTTTAAAATGTTGTTATGTGCTTGGTCTTTCTTTGCTTTTTCTT
CCATTACTTTCTTTTGAATCTTGTACTCCATCTATATATAAACAACAACAAAAAAAA
AATTGTAAATTGGTGTTGCAAATAAAATATTTTGAGTTCAATCAACCAGATAAATCA
TTTATTTTGATCTGAGTTAATGGTTTTCATTGAGTGACAAGAATCAATTGTTCCTTTT
TAAATGGACCAAGATTCTCATAACTGAAGATTACATGCAAATTACATAGATCTGAGT
TAATGGTTTTCATATGACGTTAAAAAGAATAATATAACGATGGATGATAATTATT
TCTTCTTTTTCATATTTAAAATAAAACAAAATAAACACATATGTGATTACTTAGATG
ATGACTTGTCTCGATAGATGATGATTTCAAAGAAAAATGGAAAATTATATAAAATTA
AAAAATATATTAAAATCTATAATAAATTTCGTGATAAAATCAACACAAATCATAAA
ACACATATTTATTTTAAACATAATTTATTATAATATTATTATTAATTTCGAATAATAT
ATTAATTACTGAAATATTGAATTGATGTTCATTTAAACAACAAAGGCATCAGTTGTT
CTTAACTGATTTTAAATATATATATATATATATATATATATTTGTATCATTTTCAAAT
AAGTAATTCAAAATCATATCACTTATTTTTGTGATGCAAATTAAGTGATACAATTCA
ATGGTTTTTTATATGAATATGGTATTTTTTAAAAAGCACAATTTGATGTCGGAAGTTA
AAAACAGAGACACATCAACACATTTCTGCGATTTCTTCGTAATACTAATACAAAGTA
CTTTAAAAACTAGAGTAAGTAATTACCTCTCTGAACCTAGAACATATGGACTTACAT
AGTATGTAGCACCAAAGATACAATCTAGATACAATACTCAGAAATTGTTTTCTTTAT
TCATCTTTTCAATATAATTATTTAACGGTTTGATACCAACGAATCATGCTCTATATTT
GCGTATATTCATTTGTTTATTGTATTTAAACTCAGAAACTGTACTATCATGTATCTGT
CATGTAAATCTTGAGAAAGCTACATAGTTGGTTTTACAAAGCCTAACCATGCACGTT
CTTTTTCGTTTGATTATTTCCATACGTTTTTTTTTGTTAGATTATTTCCATGTAATTTA
TTTTTTCTTCAGTACTAAATAAATATAACACGTATACTTTGACTGGAAAATCTACATT
CATATCATTTACATATTAAAAATTCCAAATAAAATTTTAAATATTTGTATATAATTCT
CGAACCTTTAGAGCAGCCTCATTGGCTAATACTGGGTAGAGGATCTCAACAATTTTA
TTTTAAATCAATACAATTTATGTTAAGCAATTAAAATCTTTTATTCTTTTCAACAAAA
AAAACAATGATAACATGCCATCTAATGTTAAAGAGTTATCACAATATCTCTACTGCT
ATACCATCTCACAATCTTTCTTTCTTTTTAATAAATTCATCGTGAGAACCTAATTTTT
ATCTCGTTTAAGTCAAAAAAAAAATCTTCATCTCATCGATGGAGGTATTCTTAGATC
TATTGATCTTTATTGTAAATCTAATTTCTTTCATCGGTAGATTTTCTATTCAAACTACA
TATATATTGTTATCCTTATTGGGATATATATTGATTATTGGGATATTGACTATTGACT
TGTGTTTTTTTTAAGAAAACAAATCTTTCATTATACCATACATATATCTCTAAGTGC
TAATAAATCGAATACAGATACAGCCACTTTCATGTGTATACAACCATATTAAAAACC
TCATCACCATCTTTTACTCTGTGTATTGAAAAGAAAAAACATAAAAGATGGATTGT
TTGCTTTGCTCACCAATTTTATATGTAGTTCTTATATTTCTTTGGTATTTGGTTAGAGT
TTTGGTAACTCGTGGAAATCCATTTCCACCTGGTCCAAAAGGCTATCCAATAATCGG
TAACATGAAACTAAAGAATCAGTTGAATCATCGTGGTTTAGCCGAGTTGGCCAAAC
AATACGGTGGTCTTCTACACCTTCAAATGGGTAAAATTCATATTGTGGCCGCTTCAA
CGGCTGAGATGGCCCGTGAAATTCTTCAGGTATGCGATTTTATACGGTTTAGAAATT
GTTTTGATATTTTAAGTATTCTTCTAAACATTTGGATAGGATAACAATGAATTTCTAG
TTTTTTTTGCAAGACAACATTCATTTCAAACATTGAGTTATGTTAGGTTCAAGATGTGG
TTTTCGCAAACGGCCAGCTAACGTGGCGATTTCATATCTTACCTACAACCGGGCCG
ATATGGCGTTTGCGAACTACGGTCCCCTCTGGCGTCAAATGAGAAAGGTTTGCGTAA
TGAAGCTGTTTAGCAGAAACGGGCCGAATCATGGGCCTCGGTTCGCGACGAAATT
AATACGATGGTTCAAACTCTGACTAAACAAACCGGTTCACCGGTTAATGTTGGTGAG
CTTGTATTTGCTTTGACGCGGAACATAACGTACCGAGCCGCGTTTGGGTCGTTCGCT
CGCGACGGTCAAGACGAATTCGTCAAGATTCTACAGGAGTTCTCAAAACTCTTTGGA
GCGTTTGATATCACTGAGTTTTTACCGTGGATGAAATGGTTTAGTAACCGCGATTTC
AGCAAGCGGTTGGAAAACGCCAGGAAATCGCTGGATGGGTTCATAGACAGAATCAT
CGATGCACATATCGAGAAGAAGAACTCAAGAAAACAAGAGGATGATGGGTTGGAG
GACGACATGGTGGATGAACTAATGGCGTTTTATAGCGGTGAGAACGGCGGCAAATC
TAACGATTCCTTGTCTACATTTAGACTCACGAGAGATAACATCAAAGCCCTTGTCAT
GGTAACTAGCTAATGGAATATAATTTATACATACATAAACCATAGGTTAATGTCATA
TTATATTTATTAATATAAAATGATTTAAAATAGGATGTGATGTTTGGCGGGACGAA
ACGGTGGCGTCTGCGATTGAATGGGCCATGACGGAGCTGATGAAGAATCCTCACGA
ACTCGTAAAGCTGCAGCAAGAGCTCGCTGACGTCATCGGATTGAACCGTCAGTTTCA
CGAATCTGATCTGGAGAATCTTCCTTACTTCAGGTGCGCGATGAAAGAGACGTTGAG
GCTACACCCTCCGATTCCTCTTCTCCTCCACGAGGCGGCGGCGGATTCCGTCGTCTCC
GGCTACTCCATTCCCCGTGACTCTCGCGTCATGATCAACGTGTACGCGATCGGGCGA
GACGGATCGGTATGGACTGAACCGATGCGTTCAGACCGGGTCGGTTTATGGAAGA
CAAAGCTCCGGATTTCAAAGGTAGTGACTTCGAGTTTCTTCCGTTTGGGTCGGGTCG
AAGGTCGTGCCCGGGTATGCAGTTGGGGCTTTATGCTATGGAGCTCGCCGTCGCGCA
CATGCTCCATTCATTTGACTGGAAGTTGCCGGAAGGAGTTAGCTCTGGTGATCTGGA
TATGACCGACATGTTTGGTCTCACGGCGCCTAGAGCCACCAGGCTCATCGCTGTTCC
GAGCTACCGGCTAAAATGTCCGATGGTGATTTGAAATTCGTGTTGTTTGATACTGTTT
TATTTCAACTGTTCGCTGTTTTCATGACTCCTTATACAATGTGTTGTTGTTTTGTTTTT

```
GTTGAACTGTTTGCTGTTTCGTGATACAATGTGTTGTTGTGGTTTAATATTCCAATCT
GTTTTCTCAATTATCCAGAATCTCGGTTGGGATTTTCCTATTTTTAAAGTAATTTCA
TGATCATGTCAGGAGTCATAACAAAAGCATAAATCAACTCTGCTTCTCCTCAGAACA
CTAACTTAGCAAAAGCTACTTAGTACCTAAAGGGGTAGTGATGGTGGTGGTGGTGGT
GGTGGTTCACTAATCTCCCAGAAGGGCATTCATAGGCAATGTGTCCCCTTCCACCAC
AGTTTCGACATATCATCAGCCTAGCCCTGCAGTCTCTGCTCATATGACCCACTTGCC
GGCAGTTCCTGCAAACCACCTCCTCCTCCCTGATTTGGGCTCTGATCCCTCGTGGTAA
CACATGGGTTTTAGGGCATTTGATAGCAAGGTGACCAGACAGGTTACAGTGATTGCA
CACGGGATCGTCTCTGCAGTCACGAGCAAAATGACCGGTCTTCCTGCACTTGTTGCA
GGCTTTCTCGTTAGTGCAATCAGCTGAGAAGTGACCTTGCTTGTAACAGTTGTTGCA
GAGTCTAAGGTCACCAGGAGGGAGGTGGCGAGCCGTGCAGTCTTTAGCTTGGTGTC
CGGCAATACCGCAGCCGTGACAAATGCCTTCGTTGGTGCAGCTATTAGACATGTGAC
CTGGTTCACGGCAGTTCCAACACAGCGACTTCGCGGAGCATTCTGATAAAATGTGCC
TGCCAAGTATTTTTATTAGAAAAATAAATAAAAAGACAGGGATATATTATCAAGTT
ATTACATTAATGTACCTTGAAGATTAGTGTATAAAAAATGTAGCAAGAACTTCAGTA
TAACAATCTAAAAACAAGTTAAAACAACGTGATGCAAAGAGCGTAAGATTGAGAAG
TAGAGAGAAAGAATAGGGTTTACCCAGGAAGGCCACAGTTGTGGCAGATAGAGACA
TTGGGACACTCTCGAGCAAAATGACCAGGTTGCTTACAATTCTTGCACATATTACTT
TGGCTGTTAATGGTAGCCAAAGGAAGAAGAAGCATATCAGTTAAGAAAAAAAAACC
AATTTGATTTCCTTCTTCTAAGAGAAATGCCAATTTTTCGATCTTAATGGAGATGAGA
GAAAAACCTGAAAGTCCGACGAGAATCTCTCCGGTAAGGATCATCACGGTAAGAAA
AACGATCAGAAGCAATCTTTCTGTCCATCGGATTCCTAATCCTCTCCAAACTCATTAT
CTTAGCAACAAAAAAAAAAAACAAAAGAGAGGGTATCATTCAATTGATGTGAATAG
GAGATGCAAAGTGTGTCTAAATTGAAAGAAGCACGGAACATCCTCCTCCATCCACTC
TAGAAAAAAAAAACATGAATAATCACACTCCTTAAGATGCGCTTAAACCCTAACAA
CGATTCTCACAACTAACTAAACCCAAAAATTAACCAAACTGCTTTTCTTACACCGTC
AGTACCTCCTTCCTTCACGTCGACGACAACCAATATTTTGACGACAACCAATTTTCC
GACAAGTAAACTGTCAGCAGTTCGACAAATCTGGCGTGCGGCGAAAGAACCTCTGC
GACACACATCCTCTTAACACGCTCACAAAACAACTCAGCAGTTATAAATGGGCTTTA
AAAGCCTTTCGTGACCCATTAACTAAGCGAGACACGCCTGTTATGTAGTAACGAATT
ACGGTTAAGTTCGGTAATGCGTCCACTTGCTCTTTTCTGATACGGTCCAGTCTACAAA
TACGTACAAACATCAAATTTGTAACATCATATGCATGGCCCATATCCCATATGCAAT
CTAAATTTCTAATGCCTACAATAAATTAATTTAACATCATATCTGCTCATCGTACTTT
GTAGTAGTAAATATAAAAGACGATCCAATTACTATCA

SEQ ID No: 113
>Radish_rs_Aokubi_v1_EVM13601
GTGCAGCGTCTGCGACAAGGCGTTTTCTTCTTACCAAGCTCTCGGCGGGC
ACAAGGCGAGTCACCGGAAAAACTCATCGCAGACTCAGTCTAGCGGAGGAGATGAG
AAATCCACGTCCTCCGCGGTAACCATCGCTAGCCACGGCGGCGGCGGCGGAGGAGG
AATTGTGAAGCCTCACGTCTGCGATCTGTAACAAGTCTTTCGCGACGGGTCAAGC
TCTCGGCGGCCACAAACGGTGCCATTACGAAGGCAAAACGGCGGCGTTGCAAGCA
GTAGCTTGTCCGTTTCCGAAGGCGTGGGGTCCACAAGCCACGTCAGCAGCGGCAGC
CATCCATCACCAACACCACCACCGTGGGTTTGACCTCAACATCCCGCCGATACCGGAG
TTCTCGACGGTCAACGGAGAAGAAGAGGTGATGAGCCCCATGCCGACGACCAAGAA
ACTGAGGCTCGAGTAGATTCAGCTAGCAGTTTAAATGAAATTTGTTATATACTGTAC
ATATACCAATTTTTAGATTCCGGTTCGTGTTCTTCTTCATTGAATCAGTATTCCTTCTT
TGTTATATTTGTGTAGTTTTCTTGTTTTCTTTAAGTTGTCGCTTAAAGAAAAAGACCC
TCAAACAATTCAAATACGTTTCAGTTTCTAAAAAACACATATTACAACCTTACGGCC
TGTTTGTTGGTCCGTTGGACTAGCTTGGTGGGCTCGTATGACTTAACCTACAAGTCTC
AGCCCATGTAAAGAGATTCGTTTGAGGTAGATAAACTGAAGTTTCCTTGCAGTATAA
TAACAAAATCCACATACAAGTAATTCTTTTAGACCTTCCTTGGTTATAAGAACAGTG
CAAAATATAAGATGTATTTTTTTCAACCATATAATGATATAAGATGTATTTGAAATC
CTTTTTTTTTTGAACGGCAACGTATTTAAACTCCATACGTATAAAATGTTATTTACATT
ACCAACCAAAAGCACCATCTTTTTTTAAGGAGCCATTCCACAACCTGACAAATATTG
ACCTACCTACTTAGCAAAAAAAAATAAAAATTGACCTACCATATAATTATTATGCGT
CCAAAGAGCATACATTATTATGTTATATATAATTGATATGTACGTCAATGTGATAAA
ATTGGCTAAACATCCAGTAAGATCATTGGTTGGTTTTGTTTATCATTTTTGTTGAATA
TCATGTACTCCCACAAAAGATTTTGCGTGGATATCCAGCTATACAACAATATACATA
GAGGTAAGACGTCCTCATTGCGAATGCGAGACAAGGCCTCTACCATCAAAACTCAA
AACGTTAAAGAAAAATCCAACAGTAACATCATACTGACAATATATTTTAACTTTGAT
AACTATGGTATTAATATAATCACAGACATGGTTACAGACTAAATAGAAATATGAGA
TCTCTCTTGAACAAAATATTCCACAGCTACTGAAATTTACGTAGCTCATTTGGTGTGT
TTGACCCCTTCTTGACACCCCTTTCATAGACACACCTGGATTCCAAAACCCCAAATT
GTAATTTTCTGTTACAAAAAAAAAATATTCTACAGCTTAATTTTAAATCGAAGTTCA
ATCCACAACGGATTAACCACTACTGACTACTAAGTTTGCTCCACTCTGTTTCGCTCTC
TAAAGAATTTTTGTCGTCTACCTAATTTAGTAGATAGAGTGAGATGATAATGCAAAT
ATACACAATACATGCCATACAAGCTACTTACGCCTGTCGTTTTCACCAAAAACTATA
TAATAAACCCTAATGATCGATCACCCTGCACGTTGTGACTTCTTTAATTGTTCTTTGC
ACCAATCAATCAATCATGGACCATGGTCACATGAAACACATTGATAAAGACCAATTT
CAATAAAATAACAGCAAATGTACACAAAAGAGGTATTAGAGTTGAAATAGTTGTTA
AGTCATATCAATCACATTATTTTCTTAACATATATAAAATAGACCCACGCACACTAA
CTCGTATCAAAATGTATACTCCAATGACTCTCATCCTTCTCGTCCCTCTTCTACTTTTC
CTTTACTGGCACCTCCTTTCACGGCGGCTAAGGTTGCGGAAATCATACCCTCCCGGC
CCAAAAGGCTTACCTATCATTGGCAATATACTCATGATGAACCAAGTCAACCACCGT
GGCCTGGCCAAACTCAGCCGCACATACGGCGGATTACTTCACCTCCGTCTCGGACTT
TCCCATCTTTTCGTAGTCTCCTCTCCTCAAATCGCACGTCAAGTCCTCCAAGTTCAAG
```

-continued

SEQUENCES

ACCACGTTTTCTCGAACCGTCCAACCACAATAGCAATCCGTTACTTGACCTACGGTC
AATCCGACTTAGCATTCGGCAATTATGGCCCGTTCTGGCGTAGGATGAGAAAACTCT
ACGTCATGATGCTCTTTAGCCGTAAACGAGCTGAGTCGTGGGCCTCTGTCGACGAAG
AGGTCCACAAAGCAGTCCGTTTTGTAGCGGCCAATGTCGGAAAACCACTAAACATA
TGCAAAGTCGCTTTCTCCTTGACAAGAGATATAACGTTCGGAGCAGCGTTCGGCTCT
TCCTCGTCAACTTCTGACGAAGGCAGACTAGATGAGTTCCTTGAGATCATACAAGAG
TTCTCTAAGCTCTTTGGTGAGTTCAACGTAGCGGATTACGTCCCGTCCTGGCTTAGTT
GGATCGACCCGCAAGGGATAAACAAGCGGGTCGAGAGAGCTCGAAAATCTCTAGAC
TGTTTCATTGAGTCAATCATCAATGATCATTTAGACAAGAAGAAGACAGAAAACAA
CGTTGACGTTGACGAGGAGACCGATATGGTTGACCAGTTACTTGCGTTCTACAAAGA
AGAAGTCAAAGTCAAGGACTCGGAGACAAAAATCAATCTCAACAACATAAAGGGC
ATCATCATGGTAAAAGCTAAACATAGTCCATTCCATCCGTTTCAAATCATACAATCA
AATTTTTAAAATAGTAGAATGTACAATTTTATTTTTATTTAACTATTAGAATTATGTA
GCATTTTAAAAAGAATTATGTAGCATTTATTTTTTAAATTTTTTAATTAGTGATAAA
AGTGAACAATTAATAAAAACAGCATTAAATCATATTTATTTTTAAAAAAATATTTAG
ACCGTAATTTGATGAACAAAATTTGGAATATGAATGCATGGAATAGATCATTCCATT
TAACTCCTTGAAAAATACACTGTTACAAGAAAAATATTATTCATAAAGCATTCCTAA
AATTCTTTTGGAATCAATGGAAAGAGAATAATTTATTTGTAAAATCATTACACAACG
TAATCGGTAAGGATCAAGTGGAATGAATGGAATGCATCATTTTATTTTTAATTTAAT
TAATAAATATATTTTATTTCTATTTCATTCCTCTTCATTCTATTTAATTACATTCTTTT
AGTTCATAATATTCCCCTAAATGATTTCCGGTTACACCCTTAGTTTATATATTTGAAA
AGTTTTTGATAACAGAATGAAAATGAAATATAGGATGTGATGTTCGGAGGAACTGA
GACGGTGGCATTAGCAATCGAGTGGGTACTAACCGAGCTACTCCGGAGCCCCGAGA
ACATGAAACGGGTCCAGGAGGAGCTAGCGACTGTGGTCGGGCTTGAGCGGTGGAGC
GTAGAGGACACACACCTTGAGAAGCTCACTTTCCTAAAATGTGTACTCAAAGAGAC
CCTCCGACTCCACCCGCCGTTCCCTCTCCTCCTCCACGAGACGGTGGAGGACGCCGA
GGTCTCCGGTTACTCCATTCCCAAGGGATCACGTGTGATGGTCAACACCTACGCTCT
CGGGCGTAACCCGAATTCCTGGTCCGACCCAGAAATATTTAACCCGAGTAGGTTCTT
GGACCCAGGTGCTCCTGATCTCAAAGGGAACAGTTTCGAGTTCATTCCGTTCGGGTC
GGGTCGGAGATCGTGTCCGGGTATGCAACTCGGGTTGTACGCTTTTGAGCTTGCGGT
GGCTCATCTACTACACTGCTTCACGTGGAAGTTACCAAACGGTGTGAAACCCGGTGA
TGTGGACACCATCGAAGGGCCTGGTCTCACCGTTCCTAAGGCGAACTCTCTTGTAGC
AGTGCCGACCACGCGCCTCCTCTCTCCCATCGTCTTGGAAAGCCACAATGTTTAAAA
AACTTGTTTTCATAAGCATTGTTTTACGTTGATATTTTCTTTCGTTATGTATATATTGT
GTTCGTGTTTAAGTTGGCATTTTTGTTCGTAAAATGTATATCCAAATAAATACATAAA
GCTTCGAAAATGTTTTGTTTTTTAAAAGATACTGACACCAAGTAGAAAGACGAATAC
ATTTTTTCAACTACTATGTGATATATATAATAATATTTCTTAAAGAAACAAATTAACT
ATGTATTTTAAATAACTGTTGCCAAAAACAGGAGAAAAATAATAGGTTACAAAAAA
ACAACACAGGAGAAAAATAATAATATAACCGATGCTTAAATACATAAACATTACA
AATAAATGGTTTAAACATAATAATTTTTAGTTATTGTTGTAAAGTAGTCTTATAAAA
GGGTAAACCCCCTTTTAAAATCACTGTTGCATTAACGGGCAGAAATGAATGTAAGTA
ACGTTCACATGTAAAACAGATATAAACATGTAATTCATAGTTTAATTAAGCAAGATA
TTGTCATCGAGTCAAAGGGTTGACTTGTGATGTCGGAGAAACAGAGAATTAAAAGC
AGTACGAGATTGAATCACCTAGTGGACTAATCTATAATGCACACACTAAATTAGAA
GTGTAGATTTATTACACAATCGTTTTAAGTAGAAGAGGAAGTCAAAGAGATTACCA
GAAATAAAAAGAGGAAGTCGAAGATAACCTTTGATATACAAAAGCATGAAGTAAGC
TTCTGAACAACAATCTTTTGCATATTAGGAGCCCAAGATGCCAAGAGGAGATTCAGC
AGTCTCACCGCAATTTCACCTTTACGTGAGACTTCTCCGTATGATTGGACTTTCTCTG
ATGCATGTCTGGATGTTCTTCTCATAATTCCTCCGGTGAGAAAAATGCAAGTGGTCT
TAGCTAACTTAGACAGAGAAAAAAAACAAAACAGTATCATGTTTCAACAAACCTT
GCATCATCAGCACTCAAGGTTTCAGTCACTTCCGGTTCTTGAAAATCAAACGTTTCC
GTCTGTTGTCTAGCAGAGACTCTGCCCATTTATACAAGAAATTAGTGACCTCTCTAA
CGCATTGTTTTAGATGGCTATTAGATATTTATCTAATAATGTCAGATTGTCACGGCTG
AACAAAATTGTTTACATGGTTTGTGGTTTCAGTTTCCCGAGTTGTAATTAAGGGAGTT
TCAGAGAATTGTGATGTAACTGCACTAATCATTCACTATGTAATTATGTTGTTGTGTT
TAATCATACCTCAATGGGTCATATTGAAAGGAATAAAAAAAAACAAAGATAAGA
TGATATTTATCCACCTTCTTCTTAGTCAACTTCAACTTCAGGATAGAGATGTGGATGC
TCAACATGCATAAATGTCTTTCTGCTTTGAAACACCTCGAGACAGATCACTGCACCA
CATAAACAATGGTAATCGATGATGGTCACGAGGGGATGTCAGAAACAGTCCAAAAT
TGTTGGAAACTCTGCCATTCTGCAAAAAAGAGAAGAGAGTAACAATAGAGATATAC
ATTTGTAATTACAACGAACTCTTATTTTTGAATGCTAAACAACATTAAATATAAATA
TAAAATAATTTAAAAAAATAAGAAACATAAAAATATAAACCAAATTTCTTGAAATA
AAACTTTAAATGAAAGTCAAAACTACTCAAATGAATTAAAAGTTTCAGAATTGAA
TTTTACGAATTCAAACTGAACCAAACCAGAATTATATGAAACAAAACAATAAACA
TCACAAGTTGAAATGTTAAATCATGGTTTTGGTATTTTAAATAAAATGCACTTGTTTA
GTGAGATATTTTACTCTTCGAATTTCATTTCAATTGCCATGTGCCATTATGTATTGTA
ATTTCAAATGTCATTAGTTTCCTTGTCCCACTGTACTCTTCTATTGAATTAGTTATCAT
GCATTTTCGAATTATTGAACTCTCGAATTATTGAACTCTGCTTTTGATCAATTTACTT
GT

SEQ ID No: 114
>Onion_AC.SP3B.Locus5396.1.10
ACTGGGAATCAAAGAAAAACAAAGAAGCAGACTCCAACGAGGGAAGCTA
GATTCAAACACAAGAACTCTTCCCCTCGCATACACAAAGCTCAAAGAAACAAAACC
AAAGCCATGATGGACATGCAATCCATCCTCATATTCACCCTCCCATTCGTCACCCTC
CTCTTCCTGGTCATTACCAGCCGCCGCAGGCCCAAACTCCCGCTTCCGCCCGGCCCG
CGCCCACTACCCATCATCGGCAACCTCAACCTCATCGACAAACTCACCCACCGTGGC -continued

| SEQUENCES |
|---|
| CTGGCCCATCTGGCCAACCAATACGGTGGCATCTTCCACCTCAAGCTTGGGTCCGTC |
| CACACCTTCTCCATCTCCACACCCGAAATCGCAAAGGAGGTCCTTCAAACCCAGGAC |
| CTGGCCTTCTCCAACCGCCCCGCCACCATCGCCATCACCTACCTCACCTACGACCGG |
| GCCGACATGGCCTTCACCCACTACGGCCCATTCTGGCGCCAAATCCGCAAACTCTGC |
| GTTATGAAGCTGTTCAGTCGAAAAGAGCGGAATCATGGGCCTCCGTCCGAGAGGA |
| GATAGAGAAGGCTGTATCGACCGCAGCCGCGGGCGCTGGGACTGTGGTCAACGTAG |
| GGGAGCTGGTGTTCAATCTGACGAAGAATATAACGTTCAGGGCGGCGTTTGGAGCG |
| AAGTCGGGCGAGGAGCAGGATGAGTTTCTGGGGATTTTGCAGGAGATATCAAAGCT |
| GTTTGGAGCGTTTAATGTCGGGGATTTCGTACCGGGTTTGAGGTACTTGGATCCACA |
| GGGGATAGGGAGGAGGATGAGGAAGGTGAGGAAGGAACTGGATGGATTTATTGAC |
| AGGATAATAGATGAGCATGTGCAGAATAGGAAGGAGGTGGATGATGTGGAGGCCG |
| ACATGGTGGATGAGATGTTGGCGTTTGTTGGACAAGGGAAGAGCATTGGTAGGGAT |
| TCTGATGAGTTGAGGCTTACTAGGAATAATATCAAGGCTATTATCATGGACGTAATG |
| TTCGGAGGAACAGAGACAGTGGCCTCGGCAATAGAATGGGCAATGGCAGAGCTCCT |
| TAAAAGCCCAGAAGATCTCAAAAGGCTCCAGCAAGAACTGACGTCGGTAGTGGGCC |
| TGGACCGCAAAGTCCAGGACTCCGACCTCGACAAACTGCCGTACCTCAAATGCGTC |
| ATCAAGGAAACGCTGCGACTTCATCCACCGATCCCGCTTCTTCTTCACGAAACAGCG |
| GAGGACTGCGAGATCCAGGGCTACTCGATCCCCAAAAAATCGAGGGTAATGATCAA |
| CGTGTGGGCGATCGGGCGCGACAAGTCCGCCTGGAAGGACGCGGACCAGTTCAAGC |
| CGTCGAGATTCGTGAAGGGAGGGGAGTACGAGCAGGTGGATTTTAAGGGGAATTTC |
| TTCGAGCTGCTGCCGTTTGGGCGGGAAGGAGGTCGTGCCCGGGGATGCAGCTGGG |
| GCTGTACGCGCTGGACCTGACGGTGGCGAATATGGCGCACTGTTTCGATTGGGAGTT |
| GCCGGACGGGATGAAGCCAGGCGAGATGGATATGAGCGACGTGTTTGGGTTGACTG |
| CGCCTAGGGCTGTGAGGCTTGCTGCTGTGCCTTCTCCTAGATTGACTTGTCGTATTTG |
| ATTTCAACATGTACATACGATTTGTGTTTATATATACGTTATAAAGTATACACAACG |
| GTGATTGTTTGTATAATTGTAATGCTGTTCCATGGTGCGGACTAATAAAAATGTTCA |
| ATGAGAGGGTTTTGAAAGACGTATGGTGTATGTGAATTGTAAATTTATATAATTGTT |
| ACTTCGTCATTAATGAAACTTTTTCA |

SEQ ID No: 115
>Lettuce_Ls_F5H_1_1 CDS WT
ATGGAATCACTTCAAATCCCCATAGCATTCTACGCTATAATAGCTATCTTA
ACTTTCTTCTTTCTTTCATGGGTCCGCCGGAAACCACTCCCGCCGGGGCCAATGGGG
TGGCCAATCATCGGCAACATGTTGATGATGGACCAACTTACCCACCGTGGCTTAGCC
CGTTTGGCAGAAAAATACGGTGGTATCCTTCATCTAAAGATGGGTTTCAGCCACACC
ATTGCAGTGTCCTCGCCGGAGATGGCGAGGATAATACTTCAAGAAAAAGATAACAT
CTTTGCCAACCGTCCGGCAACCATCGCCATCACTTACCTGACTTACAACGGCGTAGA
TTTGGCTTTTGCTAATTATGGACCTTTCTGGCGACAAATGCGAAAGCTTTGTGTCATG
AAGCTGTTCAGCCGGAAACGAGCGGAGTCATGGGACTCCGTCAGGGATGAGGTGGA
CACCATGGTGAAAGCCACCGCCATTAACTCCGGTACGCCGGTAAACTTGGGTGAGC
TTGTTTTTGGGTTGACCCATGATATTATCTACCGAGCAGCTTTTGGGTCGATTTCACA
TGAAGGGAAAGAAGAGTTTATCAGAATCCTTCAAGAATACACCAAACTTTTTGGCG
CATTCAATTTGGCTGACTTTATCCCGTTCCTCGGGTTTATTGATCCGGCGGGGTTGAA
CACACGTTTACCGGCGGCCAGGGCGGCGTTGGACGGATTCATTGACAAAATCATCG
ACGAGCATTTGCGTAAAGGAAAGAAAAACCGGCGATGAAGGTTTGGATAACGATATG
GTTGATGAGATGTTGGCGTTTTACAGCGAGGAAGGAAAAGTCAACGAAGGTGGTGA
TTTGCAAAACGCCATTAACCTTACTCGAGATAACATCAAAGCCATAATCATGGATGT
AATGTTCGGTGGAACTGAGACAGTGGCGTCCGCCATAGAATGGGCCATGACGGAGC
TAATGCATACACCGGAGGCACTAAAGCGCGTGCAACAGGAGATGGCAAATGTCGTC
GGACTTGACCGGCGCGTGGAGGAGTCTGACTTGGAGAAGCTGACGTACTTCAAATG
CGTCATCAAGGAAACCCTCCGACTACACCCTCCGATCCCAGTTCTCCTCCACCAGTC
TTCGGAGGCGACAGAAGTTTCCGGCTACCATATACCTAAAGGAACACGTGTCATGGT
GAACGCGTATGCTATTAATCGTGATAAGAACTCTTGGGAAGATCCGGATACGTTTAA
CCCGTCACGTTTTTTACAAAACGGAGCTCCGGATTTTAGAGGAAGCAACTATGAGTT
TCTGCCATTTGGTTCTGGTCGGAGGTCGTGTCCGGGGATGCAACTAGGGTTGTATGC
GATGGAGATGGCGGTGGCCCACCTTTTGCATTGTTTCACGTGGGAATTGCCGGATGG
AATGAAGCCAAGTGAAATCGACATGGGTGATGTGTTTGGACTCACAGCACCAAAG
CAATAAGATTGGTAGCAGTGCCAACTCCGCGTTTATTATGCCCATTGTATTGA SEQ ID No: 116
>Lettuce_LsF5H_2_1 CDS WT
ATGGATCCTAAGTCCATCTTACTTTACGTTGTACTCCCTCTCTTAACCTTCT
TCCTTCTCTCCCGATTACGCCGAAAACCTCTTCCGCCTGGTCCAAGAGGGTGGCCGC
TGATCGGTAACATGTTAATGATGGACCAACTCACCCACCGTGGCCTTGCTCGTTTGG
GAGAAAAATACGGTGGTCTTCTTCATCTGAAGATGGGTTTCAGCCATACCGTCGCTG
TCTCGTCCCCGAAATAGCCAGGCAAGTACTCCAAGTTCAAGACAACATCTTCGCCA
ACCGCCCGGCCACCATCGCCATTAGTTACCTCACCTACGACCGGCAAGACATGGCGT
TCGCCAACTACGGTCCCTTTTGGCGTCAGATGCGTAAGCTTTGCGTCATGAAGCTGT
TCAGCAGAAAGCGAGCTGAGTCTTGGGACTCCGTCAGAGACGAAGTTGTCTCCATG
GTCAAAATCACCGCTGCAAGCTCCGGCACCGCTGTTAACCTTGGAGAGCTTGTTTTC
GGGTTAACCCATGATATCATTTACCGAGCAGCTTTCGGGTCTATCTCTCATGAAGGA
AAAGAAGAATTCATCAGAATTCTACAAGAATACACAAAGCTTTTTGGTGCTTTCAAT
TTGGCAGATTTTGTCCCGTGGCTTGGATTTATCGACCCTGCCGGACTGAATACCCGTT
TACCGAAGGCCAGGGCGGCGCTTGACAGATTCATTGATAAAATCATCGACGAGCAC
CTTGCAAAGAGAGGAAAACGGGCGATGAGGAAGATAATGATATGGTGGATGAGA
TGTTGGCTTTTTACAGTGAAGAAGGAAAGGTAAACGAAGGCGAGGATTTGCAGAAC
GCGATTAGACTCACCCGAAACAATATCAAAGCCATTATTATGGATGTAATGTTTGGT

| SEQUENCES |
| --- |
| GGGACTGAAACTGTTGCTTCTGCTATCGAATGGGCTTTAACTGAGCTAATGCACACC
CCAGAATCCTTAAAACGTGCACAACAAGAGCTCGCTGATGTTGTTGGCCTTGATCGT
CGTGTAGAAGAATCAGATTTCGAGAAGCTAACTTACTTCAAATGTGTCATCAAAGAA
ACCTTACGTCTCCACCCTCCGATCCCTGTCCTTTTGCACCAATCATCAGAAGCCACGT
CGGTTGCTGGCTACCACATACCTAAAGGGACACGTGTCATGGTTAACGCATTCGCCA
TTAATCGTGATAAGAACTCATGGAAGGATCCACACACGTTCAACCCATCACGTTTCT
TGCAAGATGGGCACCCGACTTTAAAGGAAGCAATTATGAGTTTCTTCCATTTGGAT
CTGGACGTAGATCATGTCCTGGAATGCAACTTGGATTGTACGCAATGGAGATGGCA
GTGGCTCACCTTCTTCATTCATTCACATGGCAGTTGCCTGATGGAATGAAACCAAGT
GAGATTGACATGAATGATGTGTTTGGACTCACTGCACCAAAAGCGATTCGACTTGTT
GCTGTGCCAACTCCTCGGTTGTTGTGTCCGCTGTATTGA

SEQ ID No: 174
>Lettuce_LsF5H_1_1 CDS Mutation 1
ATGGAATCACTTCAAATCCCCATAGCATTCTACGCTATAATAGCTATCTTA
ACTTTCTTCTTTCTTTCATGGGTCCGCCGGAAACCACTCCCGCCGGGGCCAATGGGG
TGGCCAATCATCGGCAACATGTTGATGATGGACCAACTTACCCACCGTGGCTTAGCC
CGTTTGGCAGAAAAATACGGTGGTATCCTTCATCTAAAGATGGGTTTCAGCCACACC
ATTGCAGTGTCCTCGCCGGAGATGGCGAGGATAATACTTCAAGAAAAAGATAACAT
CTTTGCCAACCGTCCGGCAACCATCGCCATCACTTACCTGACTTACAACGGCGTAGA
TTTGGCTTTTGCTAATTATGGACCTTTCTGGCGATAAATGCGAAAGCTTTGTGTCATG
AAGCTGTTCAGCCGGAAACGAGCGGAGTCATGGGACTCCGTCAGGGATGAGGTGGA
CACCATGGTGAAAGCCACCGCCATTAACTCCGGTACGCCGGTAAACTTGGGTGAGC
TTGTTTTTGGGTTGACCCATGATATTATCTACCGAGCAGCTTTTGGGTCGATTTCACA
TGAAGGGAAGAAGAGTTTATCAGAATCCTTCAAGAATACACCAAACTTTTTGGCG
CATTCAATTTGGCTGACTTTATCCCGTTCCTCGGGTTTATTGATCCGGCGGGGTTGAA
CACACGTTTACCGGCGGCCAGGGCGGCGTTGGACGGATTCATTGACAAAATCATCG
ACGAGCATTTGCGTAAAGGAAAGAAAACCGGCGATGAAGGTTTGGATAACGATATG
GTTGATGAGATGTTGGCGTTTTACAGCGAGGAAGGAAAAGTCAACGAAGGTGGTGA
TTTGCAAAACGCCATTAACCTTACTCGAGATAACATCAAAGCCATAATCATGGATGT
AATGTTCGGTGGAACTGAGACAGTGGCGTCCGCCATAGAATGGGCCATGACGGAGC
TAATGCATACACCGGAGGCACTAAAGCGCGTGCAACAGGAGATGGCAAATGTCGTC
GGACTTGACCGGCGCGTGGAGGAGTCTGACTTGGAGAAGCTGACGTACTTCAAATG
CGTCATCAAGGAAACCCTCCGACTACACCCTCCGATCCCAGTTCTCCTCCACCAGTC
TTCGGAGGCGACAGAAGTTTCCGGCTACCATATACCTAAAGGAACACGTGTCATGGT
GAACGCGTATGCTATTAATCGTGATAAGAACTCTTGGGAAGATCCGGATACGTTTAA
CCCGTCACGTTTTTTACAAAACGGAGCTCCGGATTTTAGAGGAAGCAACTATGAGTT
TCTGCCATTTGGTTCTGGTCGGAGGTCGTGTCCGGGGATGCAACTAGGGTTGTATGC
GATGGAGATGGCGGTGGCCCACCTTTTGCATTGTTTCACGTGGGAATTGCCGGATGG
AATGAAGCCAAGTGAAATCGACATGGGTGATGTGTTTGGACTCACAGCACCAAAAG
CAATAAGATTGGTAGCAGTGCCAACTCCGCGTTTATTATGCCCATTGTATTGA SEQ ID No: 175
>Lettuce_LsF5H_2_1 CDS Mutation 2
ATGGATCCTAAGTCCATCTTACTTTACGTTGTACTCCCTCTCTTAACCTTCT
TCCTTCTCTCCCGATTACGCCGAAAACCTCTTCCGCCTGGTCCAAGAGGGTGGCCGC
TGATCGGTAACATGTTAATGATGGACCAACTCACCCACCGTGGCCTTGCTCGTTTGG
GAGAAAAATACGGTGGTCTTCTTCATCTGAAGATGGGTTTCAGCCATACCGTCGCTG
TCTCGTCCCCGAAATAGCCAGGCAAGTACTCCAAGTTCAAGACAACATCTTCGCCA
ACCGCCCGGCCACCATCGCCATTAGTTACCTCACCTACGACCGGCAAGACATGGCGT
CGCCAACTACGGTCCCTTTTGGCGTCAGATGCGTAAGCTTTGCGTCATGAAGCTGT
TCAGCAGAAAGCGAGCTGAGTCTTGGGACTCCGTCAGAGACGAAGTTGTCTCCATG
GTCAAAATCATCGCTGCAAGCTCCGGCACCGCTGTTAACCTTGGAGAGCTTGTTTTC
GGGTTAACCCATGATATCATTTACCGAGCAGCTTTCGGGTCTATCTCTCATGAAGGA
AAAGAAGAATTCATCAGAATTCTACAAGAATACACAAAGCTTTTTGGTGCTTTCAAT
TTGGCAGATTTTGTCCCGTGGCTTGGATTTATCGACCCTGCCGGACTGAATACCCGTT
TACCGAAGGCCAGGGCGGCGCTTGACAGATTCATTGATAAAATCATCGACGAGCAC
CTTGCAAAAGAGGAAAACGGGCGATGAGGAAGATAATGATATGGTGGATGAGA
TGTTGGCTTTTTACAGTGAAGAAGGAAAGGTAAACGAAGGCGAGGATTTGCAGAAC
GCGATTAGACTCACCCGAAACAATATCAAAGCCATTATTATGGATGTAATGTTTGGT
GGGACTGAAACTGTTGCTTCTGCTATCGAATGGGCTTTAACTGAGCTAATGCACACC
CCAGAATCCTTAAAACGTGCACAACAAGAGCTCGCTGATGTTGTTGGCCTTGATCGT
CGTGTAGAAGAATCAGATTTCGAGAAGCTAACTTACTTCAAATGTGTCATCAAAGAA
ACCTTACGTCTCCACCCTCCGATCCCTGTCCTTTTGCACCAATCATCAGAAGCCACGT
CGGTTGCTGGCTACCACATACCTAAAGGGACACGTGTCATGGTTAACGCATTCGCCA
TTAATCGTGATAAGAACTCATGGAAGGATCCACACACGTTCAACCCATCACGTTTCT
TGCAAGATGGGCACCCGACTTTAAAGGAAGCAATTATGAGTTTCTTCCATTTGGAT
CTGGACGTAGATCATGTCCTGGAATGCAACTTGGATTGTACGCAATGGAGATGGCA
GTGGCTCACCTTCTTCATTCATTCACATGGCAGTTGCCTGATGGAATGAAACCAAGT
GAGATTGACATGAATGATGTGTTTGGACTCACTGCACCAAAAGCGATTCGACTTGTT
GCTGTGCCAACTCCTCGGTTGTTGTGTCCGCTGTATTGA SEQ ID No: 176
>Lettuce_LsF5H_2_1 CDS Mutation 3
ATGGATCCTAAGTCCATCTTACTTTACGTTGTACTCCCTCTCTTAACCTTCT
TCCTTCTCTCCCGATTACGCCGAAAACCTCTTCCGCCTGGTCCAAGAGGGTGGCCGC
TGATCGGTAACATGTTAATGATGGACCAACTCACCCACCGTGGCCTTGCTCGTTTGG |

| SEQUENCES |
|---|
| GAGAAAAATACGGTGGTCTTCTTCATCTGAAGATGGGTTTCAGCCATACCGTCGCTG |
| TCTCGTCCCCCGAAATAGCCAGGCAAGTACTCCAAGTTCAAGACAACATCTTCGCCA |
| ACCGCCCGGCCACCATCGCCATTAGTTACCTCACCTACGACCGGCAAGACATGGCGT |
| TCGCCAACTACGGTCCCTTTTGGCGTCAGATGCGTAAGCTTTGCGTCATGAAGCTGT |
| TCAGCAGAAAGCGAGCTGAGTCTTGGGACTCCGTCAGAGACGAAGTTGTCTCCATG |
| GTCAAAATCACCGCTGCAAGCTCCGGCACCGCTGTTAACCTTGAAGAGCTTGTTTTC |
| GGGTTAACCCATGATATCATTTACCGAGCAGCTTTCGGGTCTATCTCTCATGAAGGA |
| AAAGAAGAATTCATCAGAATTCTACAAGAATACACAAAGCTTTTTGGTGCTTTCAAT |
| TTGGCAGATTTTGTCCCGTGGCTTGGATTTATCGACCCTGCCGGACTGAATACCCGTT |
| TACCGAAGGCCAGGGCGGCGCTTGACAGATTCATTGATAAAATCATCGACGAGCAC |
| CTTGCAAAAGAGAGGAAAACGGGCGATGAGGAAGATAATGATATGGTGGATGAGA |
| TGTTGGCTTTTTACAGTGAAGAAGGAAAGGTAAACGAAGGCGAGGATTTGCAGAAC |
| GCGATTAGACTCACCCGAAACAATATCAAAGCCATTATTATGGATGTAATGTTTGGT |
| GGGACTGAAACTGTTGCTTCTGCTATCGAATGGGCTTTAACTGAGCTAATGCACACC |
| CCAGAATCCTTAAAACGTGCACAACAAGAGCTCGCTGATGTTGTTGGCCTTGATCGT |
| CGTGTAGAAGAATCAGATTTCGAGAAGCTAACTTACTTCAAATGTGTCATCAAAGAA |
| ACCTTACGTCTCCACCCTCCGATCCCTGTCCTTTTGCACCAATCATCAGAAGCCACGT |
| CGGTTGCTGGCTACCACATACCTAAAGGGACACGTGTCATGGTTAACGCATTCGCCA |
| TTAATCGTGATAAGAACTCATGGAAGGATCCACACACGTTCAACCCATCACGTTTCT |
| TGCAAGATGGGGCACCCGACTTTAAAGGAAGCAATTATGAGTTTCTTCCATTTGGAT |
| CTGGACGTAGATCATGTCCTGGAATGCAACTTGGATTGTACGCAATGGAGATGGCA |
| GTGGCTCACCTTCTTCATTCATTCACATGGCAGTTGCCTGATGGAATGAAACCAAGT |
| GAGATTGACATGAATGATGTGTTTGGACTCACTGCACCAAAAGCGATTCGACTTGTT |
| GCTGTGCCAACTCCTCGGTTGTTGTGTCCGCTGTATTGA |

SEQ ID No: 177
>Lettuce_LsF5H_2_1 CDS Mutation 4
ATGGATCCTAAGTCCATCTTACTTTACGTTGTACTCCCTCTCTTAACCTTCT
TCCTTCTCTCCCGATTACGCCGAAAACCTCTTCCGCCTGGTCCAAGAGGGTGGCCGC
TGATCGGTAACATGTTAATGATGGACCAACTCACCCACCGTGGCCTTGCTCGTTTGG
GAGAAAAATACGGTGGTCTTCTTCATCTGAAGATGGGTTTCAGCCATACCGTCGCTG
TCTCGTCCCCCGAAATAGCCAGGCAAGTACTCCAAGTTCAAGACAACATCTTCGCCA
ACCGCCCGGCCACCATCGCCATTAGTTACCTCACCTACGACCGGCAAGACATGGCGT
TCGCCAACTACGGTCCCTTTTGGCGTCAGATGCGTAAGCTTTGCGTCATGAAGCTGT
TCAGCAGAAAGCGAGCTGAGTCTTGGGACTCCGTCAGAGACGAAGTTGTCTCCATG
GTCAAAATCACCGCTGCAAGCTCCGGCACCGCTGTTAACCTTGGAGAGCTTGTTTTC
GGGTTAACCCATGATATCATTTACCGAGCAGCTTTCGGGTCTATCTCTCATGAAGGA
AAAGAAGAATTCATCAGAATTCTACAAGAATACACAAAGCTTTTTGGTGCTTTCAAT
TTGGCAGATTTTGTCCCGTGGCTTGGATTTATCGACCCTGCCGGACTGAATACCCGTT
TACCGAAGGCCAGGGCGGCGCTTGACAGATTCATTGATAAAATCATCGACGAGCAC
CTTGCAAAAGAGAGGAAAACGGGCGATGAGGAAGATAATGATATGGTGGATGAGA
TGTTGGCTTTTTACAGTGAAGAAGGAAAGGTAAACGAAGGCGAGGATTTGCAGAAC
GCGATTAGACTCACCCGAAACAATATCAAAGCCATTATTATGGATGTAATGTTTGGT
GGGACTGAAACTGTTGCTTTTGCTATCGAATGGGCTTTAACTGAGCTAATGCACACC
CCAGAATCCTTAAAACGTGCACAACAAGAGCTCGCTGATGTTGTTGGCCTTGATCGT
CGTGTAGAAGAATCAGATTTCGAGAAGCTAACTTACTTCAAATGTGTCATCAAAGAA
ACCTTACGTCTCCACCCTCCGATCCCTGTCCTTTTGCACCAATCATCAGAAGCCACGT
CGGTTGCTGGCTACCACATACCTAAAGGGACACGTGTCATGGTTAACGCATTCGCCA
TTAATCGTGATAAGAACTCATGGAAGGATCCACACACGTTCAACCCATCACGTTTCT
TGCAAGATGGGGCACCCGACTTTAAAGGAAGCAATTATGAGTTTCTTCCATTTGGAT
CTGGACGTAGATCATGTCCTGGAATGCAACTTGGATTGTACGCAATGGAGATGGCA
GTGGCTCACCTTCTTCATTCATTCACATGGCAGTTGCCTGATGGAATGAAACCAAGT
GAGATTGACATGAATGATGTGTTTGGACTCACTGCACCAAAAGCGATTCGACTTGTT
GCTGTGCCAACTCCTCGGTTGTTGTGTCCGCTGTATTGA SEQ ID No: 178
>Lettuce_LsF5H_2_1 CDS Mutation 5
ATGGATCCTAAGTCCATCTTACTTTACGTTGTACTCCCTCTCTTAACCTTCT
TCCTTCTCTCCCGATTACGCCGAAAACCTCTTCCGCCTGGTCCAAGAGGGTGGCCGC
TGATCGGTAACATGTTAATGATGGACCAACTCACCCACCGTGGCCTTGCTCGTTTGG
GAGAAAAATACGGTGGTCTTCTTCATCTGAAGATGGGTTTCAGCCATACCGTCGCTG
TCTCGTCCCCCGAAATAGCCAGGCAAGTACTCCAAGTTCAAGACAACATCTTCGCCA
ACCGCCCGGCCACCATCGCCATTAGTTACCTCACCTACGACCGGCAAGACATGGCGT
TCGCCAACTACGGTCCCTTTTGGCGTCAGATGCGTAAGCTTTGCGTCATGAAGCTGT
TCAGCAGAAAGCGAGCTGAGTCTTGGGACTCCGTCAGAGACGAAGTTGTCTCCATG
GTCAAAATCACCGCTGCAAGCTCCGGCACCGCTGTTAACCTTGGAGAGCTTGTTTTC
GGGTTAACCCATGATATCATTTACCGAGCAGCTTTCGGGTCTATCTCTCATGAAGGA
AAAGAAGAATTCATCAGAATTCTACAAGAATACACAAAGCTTTTTGGTGCTTTCAAT
TTGGCAGATTTTGTCCCGTGGCTTGGATTTATCGACCCTGCCGGACTGAATACCCGTT
TACCGAAGGCCAGGGCGGCGCTTGACAGATTCATTGATAAAATCATCGACGAGCAC
CTTGCAAAAGAGAGGAAAACGGGCGATGAGGAAGATAATGATATGGTGGATGAGA
TGTTGGCTTTTTACAGTGAAGAAGGAAAGGTAAACGAAGGCGAGGATTTGCAGAAC
GCGATTAGACTCACCCGAAACAATATCAAAGCCATTATTATGGATGTAATGTTTGGT
GGGACTGAAACTGTTGCTTCTGCTATCGAATGGGCTTTAACTGAGCTAATGCACACC
CCAGAATCCTTAAAACGTGCACAACAAGAGCTCGCTGATGTTGTTGGCCTTGATCGT
CGTGTAGAAGAATCAGATTTCGAGAAGCTAACTTACTTCAAATGTGTCATCAAAGAA
ACCTTACGTCTCCACCCTCCGATCCCTGTCCTTTTGCACCAATCATCAGAAGCCACGT -continued

SEQUENCES

```
CGGTTGCTGGCTACCACATACCTAAAGGGACACGTGTCATGGTTAACGCATTCGCCA
TTAATCGTGATAAGAACTCATGGAAGGATCCACACACGTTCAACCCATCACGTTTCT
TGCAAGATGGGGCACCCGACTTTAAAGGAAGCAATTATGAGTTTCTTCCATTTGAAT
CTGGACGTAGATCATGTCCTGGAATGCAACTTGGATTGTACGCAATGGAGATGGCA
GTGGCTCACCTTCTTCATTCATTCACATGGCAGTTGCCTGATGGAATGAAACCAAGT
GAGATTGACATGAATGATGTGTTTGGACTCACTGCACCAAAAGCGATTCGACTTGTT
GCTGTGCCAACTCCTCGGTTGTTGTGTCCGCTGTATTGA

SEQ ID No: 179
>Lettuce_LsF5H_2_1 CDS Mutation 6
ATGGATCCTAAGTCCATCTTACTTTACGTTGTACTCCCTCTCTTAACCTTCT
TCCTTCTCTCCCGATTACGCCGAAAACCTCTTCCGCCTGGTCCAAGAGGGTGGCCGC
TGATCGGTAACATGTTAATGATGGACCAACTCACCCACCGTGGCCTTGCTCGTTTGG
GAGAAAAATACGGTGGTCTTCTTCATCTGAAGATGGGTTTCAGCCATACCGTCGCTG
TCTCGTCCCCCGAAATAGCCAGGCAAGTACTCCAAGTTCAAGACAACATCTTCGCCA
ACCGCCGGCCACCATCGCCATTAGTTACCTCACCTACGACCGGCAAGACATGGCGT
TCGCCAACTACGGTCCCTTTTGGCGTCAGATGCGTAAGCTTTGCGTCATGAAGCTGT
TCAGCAGAAAGCGAGCTGAGTCTTGGGACTCCGTCAGAGACGAAGTTGTCTCCATG
GTCAAAATCACCGCTGCAAGCTCCGGCACCGCTGTTAACCTTGGAGAGCTTGTTTTC
GGGTTAACCCATGATATCATTTACCGAGCAGCTTTCGGGTCTATCTCTCATGAAGGA
AAAGAAGAATTCATCAGAATTCTACAAGAATACACAAAGCTTTTTGGTGCTTTCAAT
TTGGCAGATTTTGTCCCGTGGCTTGGATTTATCGACCCTGCCGGACTGAATACCCGTT
TACCGAAGGCCAGGGCGGCGCTTGACAGATTCATTGATAAAATCATCGACGAGCAC
CTTGCAAAAGAGAGGAAAACGGGCGATGAGGAAGATAATGATATGGTGGATGAGA
TGTTGGCTTTTTACAGTGAAGAAGGAAAGGTAAACGAAGGCGAGGATTTGCAGAAC
GCGATTAGACTCACCCGAAACAATATCAAAGCCATTATTATGGATGTAATGTTTGGT
GGGACTGAAACTGTTGCTTCTGCTATCGAATGGGCTTTAACTGAGCTAATGCACACC
CCAGAATCCTTAAAACGTGCACAACAAGAGCTCGCTGATGTTGTTGGCCTTGATCGT
CGTGTAGAAGAATCAGATTTCGAGAAGCTAACTTACTTCAAATGTGTCATCAAAGAA
ACCTTACGTCTCCACCCTCCGATCCCTGTCCTTTTGCACCAATCATCAGAAGCCACGT
CGGTTGCTGGCTACCACATACCTAAAGGGACACGTGTCATGGTTAACGCATTCGCCA
TTAATCGTGATAAGAACTCATGGAAGGATCCACACACGTTCAACCCATCACGTTTCT
TGCAAGATGGGGCACCCGACTTTAAAGGAAGCAATTATGAGTTTCTTCCATTTGGAT
CTGAACGTAGATCATGTCCTGGAATGCAACTTGGATTGTACGCAATGGAGATGGCA
GTGGCTCACCTTCTTCATTCATTCACATGGCAGTTGCCTGATGGAATGAAACCAAGT
GAGATTGACATGAATGATGTGTTTGGACTCACTGCACCAAAAGCGATTCGACTTGTT
GCTGTGCCAACTCCTCGGTTGTTGTGTCCGCTGTATTGA
```

Although the present invention and its advantages have been described in detail, it should be understood that various changes, substitutions and alterations can be made herein without departing from the spirit and scope of the invention as defined in the appended claims.

The present invention will be further illustrated in the following Examples which are given for illustration purposes only and are not intended to limit the invention in any way.

EXAMPLES

Example 1: Creation of a *Lactuca sativa* Plant Mutant by Treatment with EMS

In order to create *Lactuca sativa* plant mutants, approximately 2000 seeds of the lettuce varieties Troubadour, Apache, Yorvik and Roderick were treated with EMS by submergence of the seeds in an aerated solution of either 0.05% (w/v) or 0.07% (w/v) EMS for 24 hours at room temperature. Following EMS treatment, the M1 seeds were rinsed with water, germinated and grown in a greenhouse at 20° C. at 16 hours light, 8 hours dark regime in order to produce M2 seeds that were harvested and bulked. The resulting population of M2 plants was screened for lettuce plants that showed reduced wound-induced discoloration by using the phenotypic test described in Example 2.

A lettuce plant which was a mutant of the variety Troubadour and did exhibit a reduced wound-induced surface discoloration compared to the WT following 3 to 5 days incubation of a leaf disc sample in the phenotypic test described in Example 2 was selected and crossed with a second lettuce plant from the variety Troubadour. An F6 line, 11K200310, was produced from this cross after repeated cycles of inbreeding in combination with plant and line selection. Selection was performed to maintain the reduced wound-induced surface discoloration and to reduce the effect of undesirable background mutations.

A second round of EMS treatment was then performed on 5000 seeds of the line 11K200310, in the same manner as previously described in the first EMS treatment, but using a concentration of 0.14% EMS instead. EMS treated seeds were then sown in a glasshouse and the resulting population of plants were then screened again for lettuce plants with wound-induced surface discoloration using the phenotypic test as described in Example 2.

Example 2: Phenotypic Identification of a Plant that Show Reduced Wound-Induced Surface Discoloration Plants from Example 1 that were grown from seeds that were either treated with one round or two rounds of EMS, were screened for their potential to show reduced wound-induced surface discoloration. Leaf disc samples were taken from the plants when these had developed approximately 6 true leaves being of the size to take a sample without cutting the middle vein. For this experiment the plants were at mature stage (approximately 2 months old) grown in a glasshouse. The obtained samples were laid on the filter paper that was moistened with MES buffer. The upper side of the leaf was in contact with the filter paper. The leaves were covered with a second filter paper also moistened with MES buffer. The air bubbles between the two filter papers were removed and the leaf discs were incubated between the wetted filter papers in a container at 7.5° C. After three, five and ten days of incubation of the leaf samples the wound-induced surface discoloration was scored by one person for the presence and intensity of wound-induced surface discoloration represented by the pink color around the edges of the leaf samples. An example of a scale used in this phenotypic identification is from 9 to 0, wherein 9 means that the edges of the leaf disc have no discoloration, score 8 means that the leaf disc has a very slight pink discoloration around the edges, score 5 means that the leaf disc has a thin ring of red/pink discoloration around the edges, score 2 means that the leaf disc has a darker and thicker ring of red/pink discoloration around the edges as compared to a leaf disc having score 9, 8, 7, 6, 5, 4 or 3 and score 0 means that the leaf disc has a very dark red and thick ring of discoloration around the edges. While different scales can be used to evaluate the intensity of wound-induced surface discoloration, the scale should range from no wound-induced surface discoloration to the highest intensity of wound-induced surface discoloration. The most interesting candidates were grown for seeds and resown and retested according to the same protocol.

Reduced wound-induced discoloration was confirmed for some candidates. The results of the phenotypic test for wound-induced surface discoloration on the leaf discs at days 3, 7 and 10 after sampling are shown in FIGS. 1, 2 and 3 and the scores are represented in Table 4; At day 3 (FIG. 1) the WT showed wound-induced surface discoloration (score 0), the plants comprising mutation 1 showed a reduced wound-induced surface discoloration (score 7) as compared to the wound-induced surface discoloration of the wild type plants and plants comprising mutation 1 and mutation 2, 3, 4, 5 or 6 did not show any wound-induced surface discoloration (score 9). At day 5 (FIG. 2) the WT showed wound-induced surface discoloration (score 0), the plants that were treated one time with EMS and had mutation 1 in their F5H1 gene homolog (Table 3) showed a reduced wound-induced surface discoloration (score 2) as compared to the WT (score 0) and plants that have been treated two rounds of EMS and had a mutation 1 in their F5H1 gene homolog (Table 3) and mutation 2, 3, 4, 5 or 6 in their F5H2 gene homolog (Table 3) did not show any wound-induced surface discoloration or a reduced wound-induced surface discoloration as compared to the plants comprising mutation 1 (scores 7 to 9). At day 10 (FIG. 3) the plants that were treated one time with EMS and had mutation 1 in their F5H1 gene homolog showed a wound-induced surface discoloration (score 0) and plants that have been treated two rounds of EMS and had a mutation 1 in their F5H1 gene homolog (Table 3) and mutation 2, 3, 4, 5 or 6 in their F5H2 gene homolog (Table 3) did not show any wound-induced surface discoloration or a reduced wound-induced surface discoloration as compared to a plant comprising mutation 1 (scores 5 to 9).

Those plants were selfed in order to produce seeds, which were then deposited with the NCIMB under accession numbers accession numbers NCIMB 42546, NCIMB 42547, NCIMB 42548, NCIMB 42549, NCIMB 42550 and NCIMB 42551.

TABLE 4

Scores of the leaf discs for phenotypic identification of a plant that show reduced wound-induced surface discoloration by at 3, 4, 5, 6, 7 and 10 days after sampling the leaf discs

| Line | Plant | 3 days | 4 days | 5 days | 6 days | 7 days | 10 days |
|---|---|---|---|---|---|---|---|
| 1 | Wild type | 0 | 0 | 0 | 0 | 0 | 0 |
| 2 | Mutation 1 | 7 | 5 | 2 | 0 | 0 | 0 |
| 3 | Mutation 1 + Mutation 2 | 9 | 9 | 8 | 7 | 7 | 5 |
| 4 | Mutation 1 + Mutation 3 | 9 | 9 | 9 | 9 | 9 | 9 |
| 5 | Mutation 1 + Mutation 4 | 9 | 9 | 7 | 7 | 5 | 5 |
| 6 | Mutation 1 + Mutation 5 | 9 | 9 | 9 | 9 | 9 | 9 |
| 7 | Mutation 1 + Mutation 6 | 9 | 9 | 9 | 9 | 9 | 9 |
| 8 | Wild type | 0 | 0 | 0 | 0 | 0 | 0 |
| 9 | Mutation 1 | 7 | 5 | 2 | 0 | 0 | 0 |

Example 3. Modifications of the *Lactuca sativa* F5H Homologs

The DNA of the *Lactuca sativa* plants resulting from the treatment with EMS and showing reduced wound-induced surface discoloration was analyzed to identify mutations in the F5H gene homologs by using standard DNA sequencing techniques. A number of mutations in the gene homologs F5H1 and F5H2 of the *Lactuca sativa* plant were identified.

The mutation in lettuce F5H gene homolog on chromosome 4, herein referred to as F5H1, resulted in a premature stop codon in the sequence of the corresponding wild type protein represented in SEQ ID No: 1. The different mutations in lettuce F5H gene on chromosome 3, herein referred to as F5H2 resulted in amino acid changes in the sequence of the corresponding wild type proteins represented in SEQ ID No: 2. The presence of the modified F5H1 protein in a *Lactuca sativa* plant results in reduced wound-induced surface discoloration. The presence of the modified F5H1 and F5H2 proteins in a *Lactuca sativa* plant enhances this effect. The mutations listed in the following Table 5 and Table 6 were identified in the F5H gene homologs of the *Lactuca sativa* plant. The tables show only parts of the F5H1 and F5H2 sequences comprising the mutated nucleotide (SNP) and 50 flanking nucleotides on either side.

TABLE 5

Sequence data of SNP mutations in the F5H1 gene homolog of *Lactuca sativa*.

| Designation | WT Sequence | |
|---|---|---|
| WT SEQ ID No: 143 | CTTACAACGGCGTAGATTTGGCTTTTGCTAATT ATGGACCTTTCTGGCGACAAATGCGAAAGCTT TGTGTCATGAAGCTGTTCAGCCGGAAACGAGC GGAG | |

| Designation | SNP Sequence | SNP Position |
|---|---|---|
| 1 SEQ ID No: 117 | CTTACAACGGCGTAGATTTGGCTTTTGCTAATT ATGGACCTTTCTGGCGATAAATGCGAAAGCTT TGTGTCATGAAGCTGTTCAGCCGGAAACGAGC GGAG | F5H1 Chr.4 370 bp |

TABLE 6

Sequence data of SNP mutations
in the F5H2 gene homolog of Lactuca sativa

| Designation | | SNP Position |
|---|---|---|
| | WT Sequence | |
| WT SEQ ID No: 150 | TGAGTCTTGGGACTCCGTCAGAGACGAAGTTG TCTCCATGGTCAAAATCACCGCTGCAAGCTCC GGCACCGCTGTTAACCTTGGAGAGCTTGTTTT CGGGT | |
| | SNP Sequence | |
| 8 SEQ ID No: 124 | TGAGTCTTGGGACTCCGTCAGAGACGAAGTTG TCTCCATGGTCAAAATCATCGCTGCAAGCTCC GGCACCGCTGTTAACCTTGGAGAGCTTGTTTT CGGGT | F5H2 Chr. 3 461 bp |
| | WT Sequence | |
| WT SEQ ID No: 151 | CTCCATGGTCAAAATCACCGCTGCAAGCTCCG GCACCGCTGTTAACCTTGGAGAGCTTGTTTTC GGGTTAACCCATGATATCATTTACCGAGCAGC TTTCG | |
| | SNP Sequence | |
| 9 SEQ ID No: 125 | CTCCATGGTCAAAATCACCGCTGCAAGCTCCG GCACCGCTGTTAACCTTGAAGAGCTTGTTTTC GGGTTAACCCATGATATCATTTACCGAGCAGC TTTCG | F5H2 Chr.3 494 bp |
| | WT Sequence | |
| WT SEQ ID No: 152 | CAAAGCCATTATTATGGATGTAATGTTTGGTG GGACTGAAACTGTTGCTTCTGCTATCGAATGG GCTTTAACTGAGCTAATGCACACCCCAGAATC CTTAA | |
| | SNP Sequence | |
| 10 SEQ ID No: 126 | CAAAGCCATTATTATGGATGTAATGTTTGGTG GGACTGAAACTGTTGCTTTTGCTATCGAATGG GCTTTAACTGAGCTAATGCACACCCCAGAATC CTTAA | F5H2 Chr.3 923 bp |
| | WT Sequence | |
| WT SEQ ID No: 153 | AGATGGGGCACCCGACTTTAAAGGAAGCAATT ATGAGTTTCTTCCATTTGGATCGGACGTAGA TCATGTCCTGGAATGCAACTTGGATTGTACGC AATGG | |
| | SNP Sequence | |
| 11 SEQ ID No: 127 | AGATGGGGCACCCGACTTTAAAGGAAGCAATT ATGAGTTTCTTCCATTTGAATCGGACGTAGA TCATGTCCTGGAATGCAACTTGGATTGTACGC AATGG | F5H2 Chr.3 1301 bp |
| | WT Sequence | |
| WT SEQ ID No: 154 | GGCACCCGACTTTAAAGGAAGCAATTATGAGT TTCTTCCATTTGGATCTGGACGTAGATCATGT CCTGGAATGCAACTTGGATTGTACGCAATGGA GATGG | |
| | SNP Sequence | |
| 12 SEQ ID No: 128 | GGCACCCGACTTTAAAGGAAGCAATTATGAGT TTCTTCCATTTGGATCTGAACGTAGATCATGT CCTGGAATGCAACTTGGATTGTACGCAATGGA GATGG | F5H2 Chr.3 1307 bp |

Example 4. Identification of F5H Gene Orthologs and Conserved Regions

The DNA of the *Lactuca sativa* plants resulting from the treatment with EMS and showing reduced wound-induced surface discoloration was analyzed to identify mutations in the F5H gene homologs by using standard DNA sequencing techniques. A number of mutations in the gene homologs F5H1 and F5H2 of the *Lactuca sativa* plant were identified.

F5H gene orthologs in others crop species were identified by using a BLASTN and BLASTP program in order to compare the DNA and the protein sequences of F5H1 and F5H2 of the *Lactuca sativa* plant with the sequences of other crops species. The best hits per species were identified as candidate F5H1 and F5H2 gene orthologs. A non-limitative list of plants that carry one or more F5H gene orthologs are represented in the following table.

TABLE 7

List of plant species that carry a F5H gene ortholog and number of gene orthologs present in the genome of these plants. The SEQ ID numbers of the F5H gene ortholog sequences are listed in Table 2.

| Plant crops | Number of F5H gene orthologs |
|---|---|
| Potato (*Solanum tuberosum*) | 1 |
| Onion (*Allium cepa*) | 1 |
| Artichocke (*Cynara cardunculus* var. *Scolymus*) | 2 |
| Rice (*Oryza sativa*) | 2 |
| Corn (*Zea mays*) | 2 |
| Peach (*Prunus persica*) | 2 |
| Eggplant (*Solanum melongena*) | 2 |
| Chicory (*Cichorium intybus*) | 3 |
| Endive (*Cichorium endivia*) | 3 |
| Celery and celeriac (*Apium graveolens*) | 3 |
| Apple (*Malus domestica*) | 3 |
| Banana (*Musa acuminata*) | 4 |
| Soy (*Glycine max*) | 5 |
| Pear (*Pyrus x bretschneideri*) | 5 |
| Wheat (*Triticum aestivum*) | 5 |
| Radish (*Raphanus sativus*) | 5 |
| Cabbage and cauliflower (*Brassica oleracea*) | 5 |

The alignments revealed the presence of highly conserved amino acids amongst the F5H gene orthologs of different species. Examples of highly conserved amino acid regions highlighted within the sequences of F5H gene orthologs in the protein sequence alignment FIG. 4 are listed in Table 1.

Example 5: Development of New Plants Having the Trait of the Invention

A lettuce plant numbered 15E238260 showing reduced wound-induced discoloration after 10 days of incubation and found by the phenotypic test described in Example 2 was selfed. By use of DNA-marker tests based on SNPs markers in Example 3 plant 15E238260 was shown to be homozygous for the mutation in the F5H1 gene homolog and a mutation in the F5H2 gene homolog. Flowers of plant 15E238260 were used as a pollen donor to make a cross with a plant of the lettuce variety Hofnar that showed wound-induced surface discoloration in the phenotypic test described in Example 2 just like the wild type plant. The above-mentioned cross result in an F1-seed lot numbered 15E97481.

Four F1-seeds were sown and the resulting plants numbered 15E748101, 15E748102, 15E748103, and 15E748104, were selfed to produce F2-seeds. These F2-seeds are sown and the individual F2-plants were tested for reduced wound-induced surface discoloration by the phenotypic test described in Example 2. Three out of each sixteen F2-plants were expected to show reduced wound-induced surface discoloration after 3 to 5 days and one out of each sixteen F2-plants was expected to show reduced wound-induced surface discoloration ten days of incubation of the leaf discs at 7.5° C. as described in Example 2.

The F2 plants that showed a reduced wound-induced surface discoloration after 10 days of incubation were therefore expected to be homozygous for the mutation in the F5H1 gene homolog as well as for a mutation in the F5H2 gene homolog. The selected F2-plant was selfed to produce F3-seeds. By growing ten F3-plants out of this seed lot and observing a reduced wound-induced surface discoloration for each of them after ten days of incubation (as in Example 2), the homozygous presence of the two mutated genes in the selected F2-plant was confirmed. The selection of the plant and the confirmation of the selected genotype was done by using a molecular marker recognizing the difference between the wild type and the mutant genes.

Example 6: Introgression of the Trait of the Invention by Backcrossing

To introgress both the mutation of the F5H1 gene homolog and the mutation of the F5H2 gene homolog in the lettuce variety Hofnar a backcross with variety Hofnar as recurrent parent is performed. For this purpose, the selected F2-plant showing a reduced wound-induced surface discoloration after ten days of incubation by using the phenotypic test as described in Example 2 was used as a parent in a cross with Hofnar. The resulting BC1-seed was sown and a BC1-plant was used as a parent in a cross with Hofnar to generate BC2-seeds. 20 BC2-seeds were sown and each of them was selfed to generate BC2.S1-seeds. These 20 BC2.S1-seed lots (i.e. BC2.S1families) were sown, 20 BC2.S1 plants per seed lot, to select a BC2.S1-family, which was segregating for both the mutation of the F5H1 gene homolog and the mutation of the F5H2 gene homolog. For this purpose, each of the 20 plants per BC2.S1-family was tested with the phenotypic test as described in Example 2 with an incubation time of ten days. After these ten days a BC2.S1-family is selected which showed segregation for the reduced wound-induced discoloration phenotype. From such a family a BC2.S1-plant with the reduced wound-induced surface discoloration phenotype was selected and used as a parent in a BC3-cross with Hofnar. This BC2.S1-plant was also selfed to produce BC2.S2-seeds. Ten BC2.S2-seeds were grown into plants and tested in the phenotypic test as described in Example 2, to confirm the reduced wound-induced discoloration in all of them, after 10 days, they indeed show no or reduced wound-induce discoloration in the phenotypic test. This confirmed the homozygous presence of the mutation in F5H1 gene homolog as well as the homozygous presence of the mutation in F5H2 gene homolog. The selection of the plant and the confirmation of the selected genotype could have also been done by using a molecular marker recognizing the difference between the wild type and the mutant genes.

The resulting BC3-seed was sown and a BC3-plant was used as a parent in a cross with Hofnar to generate BC4-seeds. 20 BC4-seeds were sown and each of them was selfed to generate BC4.S1-seeds. These 20 BC4.S1-seed lots (i.e. BC4.S1families) were sown, 20 BC4.S1 plants per seed lot, to select a BC4.S1-family, which was segregating for both the mutation of the F5H1 gene homolog and the mutation of the F5H2 gene homolog. For this purpose, each of the 20 plants per BC4.S1-family was tested with the wound-induced discoloration test as described in Example 2 with an incubation time of ten days. After these ten days a BC4.S1-family was selected which showed segregation for the reduced wound-induced surface discoloration phenotype. From such a family a BC4.S1-plant with the reduced wound-induced surface discoloration phenotype was selected and could be used as a parent in a BC5-cross with Hofnar. This BC4.S1-plant was also selfed to produce BC4. S2-seeds, of which ten seeds were sown to confirm the reduced wound-induced surface discoloration in all of them. The selection of the plant and the confirmation of the selected genotype could also be done by using a molecular marker recognizing the difference between the wild type and the mutant genes, e.g. markers based on the SNPs as described in Example 3. The genotype of each selected plant could also be confirmed by using molecular markers.

The BC4.S2-seeds were sown in a trial and the resulting plants are compared with plants of the variety Hofnar grown in the same trial. In this way it is established whether the BC4-generation is sufficiently similar to Hofnar to be used by growers in practice.

Example 7: Segregation Analysis of the Trait of the Invention

A lettuce plant numbered 15E238260 showing reduced wound-induced discoloration and comprising mutation 1 ($C_{370}>T_{370}$ in the F5H1 gene homolog) and mutation 3 ($G_{494}>A_{494}$ in the F5H2 gene homolog) in a homozygous state was used for the segregation analysis. Flowers of plant 15E238260 were used as a pollen donor to make a cross with a plant of the lettuce variety Troubadour that showed wound-induced surface discoloration in the phenotypic test described in Example 2 just like the wild type plant in order to obtain F1-seeds.

The F1 plants grown from the F1 seeds were sown and selfed to produce F2-seeds. The plants grown from the F2 seeds were used to analyze the segregation of the trait of the invention.

The mutations were homozygously absent, heterozygously present or homozygously present in a plant. The different genotypes and their denomination in this application are represented in Table 8. The reduced wound-induced surface discoloration was evaluated by using the leaf disc test as described in Example 2, but for the segregation analysis, the leaf discs were taken from young plants (approximately 2 weeks old). The score for each leaf disc is represented in Table 9 and as an example the leafs discs of a lettuce plant comprising mutation 1 and mutation 3 are represented in FIG. 6.

TABLE 8

Representation of the genotype of the plants used for the segregation analysis represented in FIG. 6

| Mutation 1 | Mutation 3 | Genotype |
|---|---|---|
| Homozygously absent | Homozygously absent | AA/AA |
| Heterozygously present | Homozygously absent | AB/AA |
| Homozygously absent | Heterozygously present | AA/AB |
| Heterozygously present | Heterozygously present | AB/AB |
| Homozygously present | Heterozygously present | BB/AB |
| Heterozygously present | Homozygously present | AB/BB |
| Homozygously absent | Homozygously present | AA/BB |
| Homozygously present | Homozygously absent | BB/AA |
| Homozygously present | Homozygously present | BB/BB |

TABLE 9

Phenotypic analysis of the F2 population of plants comprising mutation 1 and mutation 3 The genotypes of the plants are represented in Table 8:

| Genotype | | Phenotype (Scores) | | | |
|---|---|---|---|---|---|
| Mutation 1 | Mutation 3 | 1 Day | 2 Days | 3 Days | 4 Days |
| AA | AA | 9 | 2 | 0 | 0 |
| AB | AA | 9 | 2 | 1 | 0 |
| AA | AB | 9 | 2 | 1 | 0.5 |
| AB | AB | 9 | 2 | 1 | 0 |
| AB | BB | 9 | 2 | 0 | 0 |
| AA | BB | 9 | 1 | 1 | 0 |
| BB | AA | 9 | 8 | 8 | 7 |
| BB | BB | 9 | 9 | 9 | 9 |
| BB | AB | 9 | 9 | 9 | 8 |

The results in Table 9 show that in order to show reduced wound-induced surface discoloration the plant needed to carry mutation 1 on the F5H1 gene homolog ($C_{370}>T_{370}$ in the F5H1 gene homolog). Preferably the plant carried mutation 1 homozygously. A plant that carried mutation 1 homozygously (BB) and mutation 3 heterozygously (AB) or homozygously (BB) showed a reduced wound-induced surface discoloration as compared to the wild-type (AA/AA) and to plants that carried only mutation 1. The most reduced wound-induced surface discoloration was visible in a plant comprising mutation 1 in the F5H1 gene homozygously and mutation 3 in F5H2 gene homozygously (BB/BB).

Example 8: Phenotypic Analysis of Whole Lettuce Heads

The lettuce plants were harvested at maturity stage (approximately 3 months old), preferably the plants in the middle of the plot were chosen for the phenotypic analysis. The harvested plants were stored in a cooling room at 5° C. over night in boxes that were wrapped in plastic to avoid drying out. The plants were then cut under cold temperature (around 15° C.). Old leaves, leaves showing tipburn symptoms and outer leaves were removed from the heads. Two or three plant heads comprising mutation 1, mutation 1 and mutation 2, mutation 1 and mutation 3, mutation 1 and mutation 4, mutation 1 and mutation 5, mutation 1 and mutation 6 and a wild type plant (Troubadour) were vertically cut in four parts to remove the core and the four parts were further cut 2 or 3 times horizontally. For the phenotypic analysis 100 grams of the cut lettuce leaves were washed with a washing machine (Washing step with air bubbles: 3 min, time of centrifuge: 2.5 min with the highest speed) and the water was replaced after each washing step. For washing on a small scale, water should be as cold as possible and the washing should be done in a large sink. The cut and washed leaves were dried in a salad spinner.

The cut leaves were filled in dry plastic bags without ethylene that were folded 2 times and stored in boxes and stored at 5-6° C. The bags were not stocked on top of each other.

An example of the phenotypic analysis on whole lettuce heads is shown in FIG. 7 for the wild type lettuce variety Troubadour (wild type) that does not comprise a modified F5H gene homolog, a lettuce plant comprising mutation 1 ($C_{370}>T_{370}$ in the F5H1 gene homolog) ("Mutation 1") and a lettuce plant comprising mutation 1 and mutation 3 ($G_{494}>A_{494}$ in the F5H2 gene homolog) ("Mutation 1 and mutation 3"). The pictures were taken after 7 and 10 days after after washing. The wild type plant showed wound-induced surface discoloration and the cutting edges after 7 days, the plant comprising mutation 1 showed a reduced wound-induced surface discoloration at the cutting edges after 7 or 10 days as compared to the wild type, the plant comprising mutation 1 and mutation 3 do not show any wound-induced surface discoloration even after 10 days and has therefore a reduced wound-induced surface discoloration as compared to plants comprising mutation 1.

Another analysis has been performed with an evaluation of the wound-induced surface discoloration at 3, 7 and 14 days after washing. The results are represented in Table 10. A plant that may comprise mutation 1 showed reduced wound-induced surface discoloration as compared to the wild type. Plants that comprise mutation 1 and mutation 3, 4, 5 or 6 showed reduced wound-induced surface discoloration as compared to the wild-type and the plant comprising mutation 1. Plants comprising mutation 1 and mutation 2 showed the same reduction in wound induced surface discoloration as a plant comprising mutation 1 at 14 days, but the wound-induced surface discoloration develops slower than in a plant comprising mutation 1 as at 7 Days a plant comprising mutation 1 has a score of 7 and a plant comprising mutation 1 and mutation 2 scores 8.

TABLE 10

Phenotypic analysis of whole lettuce heads after cutting the heads, washing the leaves and storing the leaves for 3, 7 and 9 or 14 days at 5-6° C.:

| | Days of storage | | |
|---|---|---|---|
| Plant type | 3 Days | 7 Days | 14 Days |
| Wild type | 9 | 5 | 4 |
| Mutation 1 | 9 | 7 | 5 |
| Mutation 1 + mutation 2 | 9 | 8 | 5 |
| Mutation 1 + mutation 3 | 9 | 9 | 7.5 |
| Mutation 1 + mutation 4 | 9 | 8 | 6.5 |
| Mutation 1 + mutation 5 | 9 | 8.5 | 6 |
| Mutation 1 + mutation 6 | 9 | 8 | 7 |

The invention is further described by the following numbered paragraphs:

1. A plant comprising a modified F5H gene homolog, wherein said gene homolog comprises a modification as compared to its corresponding wild type F5H gene homolog, wherein the presence of the modified F5H gene homolog in the plant leads to a reduction of wound-induced surface discoloration in comparison to a plant not comprising the modified F5H gene homolog.

2. Plant of paragraph 1, wherein the wild type F5H gene sequence is represented by any one of SEQ ID Nos: 58 to 114.

3. Plant of any of the paragraphs 1-2, wherein the plant is selected from the group consisting of *Solanum tuberosum, Allium cepa, Lactuca sativa, Cynara cardunculus* var. *Scolymus, Oryza sativa, Zea mays, Prunus persica, Solanum melongena, Cichorium intybus, Cichorium endivia, Apium graveolens, Malus domestica, Musa acuminate, Glycine max, Pyrus×bretschneideri, Triticum aestivum, Raphanus sativus* and *Brassica oleracea*, the wild type F5H gene sequence SEQ ID numbers of which are listed in Table 2.

4. Plant of any one of the paragraphs 1-2, wherein the plant comprises two modified F5H gene homologs.

5. Plant of paragraph 4, wherein the plant is selected from the group consisting of *Lactuca sativa, Cynara cardunculus* var. *Scolymus, Oryza sativa Japonica, Zea mays, Prunus persica, Solanum melongena, Cichorium intybus, Cichorium endivia, Apium graveolens, Malus domestica, Musa acuminate, Glycine max, Pyrus×bretschneideri, Triticum*

*aestivum, Raphanus sativus* and *Brassica oleracea*, the wild type F5H gene sequence SEQ ID numbers of which are listed in Table 2.

6. Plant of any one of the paragraphs 1-2, wherein the plant comprises three modified F5H gene homologs.

7. Plant of paragraph 6, wherein the plant is selected from the group consisting of *Cichorium intybus, Cichorium endivia, Apium graveolens, Malus domestica, Musa acuminate, Glycine max, Pyrus×bretschneideri, Triticum aestivum, Raphanus sativus* and *Brassica oleracea*, the wild type F5H gene sequence SEQ ID numbers of which are listed in Table 2.

8. Plant of any one of the paragraphs 1-2, wherein the plant comprises four modified F5H gene homologs.

9. Plant of paragraph 8, wherein the plant is selected from the group consisting of *Musa acuminate, Glycine max, Pyrus×bretschneideri, Triticum aestivum, Raphanus sativus* and *Brassica oleracea*, the wild type F5H gene sequence SEQ ID numbers of which are listed in Table 2.

10. Plant of any one of the paragraphs 1-2, wherein the plant comprises five or more modified F5H gene homologs.

11. Plant of paragraph 10, wherein the plant is selected from the group consisting of *Glycine max, Pyrus× bretschneideri, Triticum aestivum, Raphanus sativus* and *Brassica oleracea*, the wild type F5H gene sequence SEQ ID numbers of which are listed in Table 2.

12. Plant of any one of the paragraphs 1-11, wherein the modification leads to a reduction or absence of the protein expression of the F5H1 protein homolog as compared to the expression of the protein produced by the corresponding wild type F5H1 gene homolog.

13. Plant of any one of the paragraphs 1-12, wherein the modification leads to a reduction or absence of the protein activity of the F5H1 protein homolog as compared to the activity of the protein produced by the corresponding wild type F5H1 gene homolog.

14. Plant of any one of the paragraphs 1-13, wherein the modification leads to a premature stop codon.

15. Plant of any one of the paragraphs 1-5 and 12-14, wherein the plant is a *Lactuca sativa* plant and comprises a first modified F5H gene homolog called F5H1, the wild type of which has SEQ ID No. 115, and optionally a second modified F5H gene homolog called F5H2, the wild type of which has SEQ ID No. 116.

16. Plant of paragraph 15, wherein the modified F5H1 gene homolog is homozygously present and the modified F5H2 gene homolog is either heterozygously or homozygously present.

17. Plant as paragraphed any one of the paragraphs 15-16, wherein the modified F5H1 gene comprises a premature stop codon.

18. Plant of paragraph 17, wherein the plant is a *Lactuca sativa* plant and the premature stop codon is caused by a mutation C>T at position 370 of SEQ ID No: 115.

19. Plant according to paragraph 17, wherein the plant is another plant listed in FIG. 4 and the premature stop codon is caused by a mutation at a position that corresponds to position 370 of SEQ ID No: 115 in *Lactuca sativa*.

20. Plant of any one of the paragraphs 15-19, wherein the modified F5H2 gene encodes a protein having one or more amino acid substitutions.

21. Plant of any one of the paragraphs 15-20, wherein the plant is a *Lactuca sativa* plant and the modified F5H2 gene comprises a mutation resulting in an amino acid substitution of Threonine to Isoleucine at position 154 of the encoded F5H2 protein of SEQ ID No: 2, and/or an amino acid substitution of Glycine to Glutamic acid at position 165 of the encoded F5H2 protein of SEQ ID No: 2, and/or an amino acid substitution of Serine to Phenylalanine at position 308 of the encoded F5H2 protein of SEQ ID No: 2, and/or an amino acid substitution of Glycine to Glutamic acid at position 434 of the encoded F5H2 protein of SEQ ID No: 2, and/or an amino acid substitution of Glycine to Glutamic acid at position 436 of the encoded F5H2 protein of SEQ ID No: 2.

22. Plant of paragraph 21, wherein the amino acid substitution of Threonine to Isoleucine at position 154 of the encoded F5H2 protein is the result of a nucleotide change C>T at position 461 of SEQ ID No: 116, the amino acid substitution of Glycine to Glutamic acid at position 165 of the encoded F5H2 protein is the result of a nucleotide change G>A at position 494 of SEQ ID No: 116, the amino acid substitution of Serine to Phenylalanine at position 308 of the encoded F5H2 protein is the result of a nucleotide change C>T at position 923 of SEQ ID No: 116, the amino acid substitution of Glycine to Glutamic acid at position 434 of the encoded F5H2 protein is the result of a nucleotide change G>A at position 1301 of SEQ ID No: 116 and the amino acid substitution of Glycine to Glutamic acid at position 436 of the encoded F5H2 protein is the result of a nucleotide change G>A at position 1307 of SEQ ID No: 116.

23. Plants according to paragraph 20 or 22, wherein the plant is another plant listed in FIG. 4 and the amino acid substitution is at a position that corresponds to the position in *Lactuca sativa*.

24. Part of a plant of any one of the paragraphs 1-23, wherein the part is a leaf, a whole head of a plant, a fruit, an inflorescence, a seed, a curd, a stem, a tuber, a bulb or a root, optionally in processed form.

25. A food product comprising a part of a plant of paragraph 24.

26. A seed capable of developing into a plant of any one of the paragraphs 1-23.

27. Seed of a plant of any one of the paragraphs 1-23, wherein the seed comprises a modified F5H gene homolog in its genome.

28. Propagation material capable of developing into and/or derived from a plant of any one of the paragraphs 1-23, wherein the propagation material is selected from the group consisting of a microspore, pollen, ovary, ovule, embryo, embryo sac, egg cell, cutting, root, root tip, hypocotyl, cotyledon, stem, leaf, flower, anther, seed, meristematic cell, protoplast and a cell, or a tissue culture thereof.

29. A modified F5H gene homolog as defined in any one of the paragraphs 1-23 that confers reduced wound-induced surface discoloration to the plant.

30. Use of a modified F5H gene homolog as defined in any one of the paragraphs 1-23 for the development of a plant exhibiting reduced wound-induced surface discoloration.

31. A plant of any of the paragraphs 1-23, wherein reduction of the endogenous level of the F5H1 protein is due to a premature stop codon in the wild-type F5H sequences listed in Table 2.

32. Method for producing a plant exhibiting reduced wound-induced surface discoloration, comprising reducing the endogenous level of F5H1 protein in the plant.

33. Method of paragraph 32, wherein the endogenous level of F5H1 protein in the plant is reduced by mutating a wild type F5H1 gene homolog.

34. The method of paragraphs 32 or 33, wherein the mutation is effected by CRISPR, by a chemical agent, radiation, or a combination thereof.

35. The method of paragraph 32 wherein reducing the endogenous level of F5H1 protein in the plant is accomplished by reducing the expression of a F5H1 gene homolog of the plant by gene silencing or RNAi.

36. The method of any one of the paragraphs 32-35, wherein the wild type F5H1 gene homolog or homologs have the nucleotide sequence and corresponding amino acid sequence of which the SEQ ID numbers are listed in Table 2.

37. A plant comprising a reduced F5H1 expression, wherein the reduction is caused by one of the methods of paragraphs 32-36.

38. A method for selecting a plant showing reduced wound-induced surface discoloration, wherein the method comprises screening a plant or a population of plants for the presence of a modified F5H gene homolog as described in any one of the paragraphs 1-23, optionally applying a phenotypic test to identify plants showing reduced wound-induced surface discoloration, and selecting a plant showing reduced wound-induced surface discoloration.

39. A molecular marker for detecting in the genome of a plant a mutation causative of reduced wound-induced surface discoloration in said plant or a part thereof, wherein the marker is a mutation in any of the F5H wild type sequences, the SEQ ID numbers of which wild type sequences are shown in Table 2.

40. Molecular marker of paragraph 39, wherein the mutation is a nucleotide change of C>T at position 370 of SEQ ID No: 115.

41. Molecular marker of paragraph 39, wherein the mutation is an amino acid substitution of Threonine to Isoleucine at position 154 of the encoded protein as a result of a change C>T at position 461 of SEQ ID No: 116, and/or an amino acid substitution of Glycine to Glutamic acid at position 165 of the encoded protein as a result of a change G>A at position 494 of SEQ ID No: 116 and/or an amino acid substitution of Serine to Phenylalanine at position 308 of the encoded protein as a result of a change C>T at position 923 of SEQ ID No: 116, and/or an amino acid substitution of Glycine to Glutamic acid at position 434 of the encoded protein as a result of a change G>A at position 1301 of SEQ ID No: 116, and/or an amino acid substitution of Glycine to Glutamic acid at position 436 of the encoded protein as a result of a change G>A at position 1307 of SEQ ID No: 116.

42. Use of a molecular marker of any of the paragraphs 39-41, to identify or develop a plant showing reduced wound-induced surface discoloration, or develop other markers linked to a modified F5H gene homolog as defined in any of the paragraphs 1-23.

43. A method for identifying molecular markers linked to reduced wound-induced surface discoloration of a plant, comprising:

a) isolating DNA from a plant and from one or both parents of said plant;

b) screening for molecular markers in a region of said DNA at or near a sequence corresponding to SEQ ID Nos: 175, 176, 177, 178 or 179.

c) determining co-inheritance of said markers with the reduced wound-induced surface discoloration phenotype from one or both parents of said plant.

44. A method for producing a plant showing reduced wound-induced surface discoloration comprising:

(a) crossing a plant comprising a modified F5H gene homolog of paragraph 1, with another plant;

(b) optionally performing one or more rounds of selfing and/or crossing; and (c) optionally selecting after each round of selfing or crossing for a plant that comprises said reduced wound-induced surface discoloration.

45. Method of paragraph 44, wherein the plant is phenotypically selected and/or selected by use of molecular markers.

46. A method of producing a hybrid plant seed comprising crossing a first parent plant with a second parent plant and harvesting the resultant plant seed, wherein said first parent plant and/or said second parent plant comprises a modified F5H gene homolog as defined in paragraph 1.

47. A method of determining the presence of a modified F5H gene homolog in a plant according to paragraph 1, comprising the steps of obtaining a sample of nucleic acids from said plant, comparing said nucleic acids to a sample of nucleic acids obtained from a reference plant comprising the wild type F5H gene homolog, and detecting a polymorphism between the two nucleic acid samples, wherein the detected polymorphism is indicative of the presence of said modified F5H gene homolog.

48. Method of paragraph 47, wherein the wild type F5H gene homolog is any one of the sequences of which the SEQ ID numbers are listed in Table 2.

Having thus described in detail preferred embodiments of the present invention, it is to be understood that the invention defined by the above paragraphs is not to be limited to particular details set forth in the above description as many apparent variations thereof are possible without departing from the spirit or scope of the present invention.

SEQUENCE LISTING (179 sequences)

SEQ ID NO: 1 - protein, 506 aa, Lactuca sativa
MESLQIPIAFYAIIAILTFFFLSWVRRKPLPPGPMGWPIIGNMLMMDQLTHRGLARLAEKYGGILHLKMGFSHTIAVSSPEMARIILQEKDNIFANRPATIAITYLTYNGVDLAFANYGPFWRQMRKLCVMKLFSRKRAESWDSVRDEVDTMVKATAINSGTPVNLGELVFGLTHDIIYRAAFGSISHEGKEEFIRILQEYTKLFGAFNLADFIPFLGFIDPAGLNTRLPAARAALDGFIDKIIDEHLRKGKKTGDEGLDNDMVDEMLAFYSEEGKVNEGGDLQNAINLTRDNIKAIIMDVMFGGTETVASAIEWAMTELMHTPEALKRVQQEMANVVGLDRRVEESDLEKLTYFKCVIKETLRLHPPIPVLLHQSSEATEVSGYHIPKGTRVMVNAYAINRDKNSWEDPDTFNPSRFLQNGAPDFRGSNYEFLPFGSGRRSCPGMQLGLYAMEMAVAHLLHCFTWELPDGMKPSEIDMGDVFGLTAPKAIRLVAVPTPRLLCPLY

SEQ ID NO: 2 - protein, 503 aa, Lactuca sativa
MDPKSILLYVVLPLLTFFLLSRLRRKPLPPGPRGWPLIGNMLMMDQLTHRGLARLGEKYGGLLHLKMGFSHTVAVSSPEIARQVLQVQDNIFANRPATIAISYLTYDRQDMAFANYGPFWRQMRKLCVMKLFSRKRAESWDSVRDEVVSMVKITAASSGTAVNLGELVFGLTHDIIYRAAFGSISHEGKEEFIRILQEYTKLFGAFNLADFVPWLGFIDPAGLNTRLPKARAALDRFIDKIIDEHLAKERKTGDEEDNDMVDEMLAFYSEEGKVNEGEDLQNAIRLTRNNIKAIIMDVMFGGTETVASAIEWALTELMHTPESLKRAQQELADVVGLDRRVEESDFEKLTYFKCVIKETLRLHPPIPVLLHQSSEATSVAGYHIPKGTRVMVNAFAINRDKNSWKDPHTFNPSRFLQDGAPDFKGSNYEFLPFGSGRRSCPGMQLGLYAMEMAVAHLLHSFTWQLPDGMKPSEIDMNDVFGLTAPKAIRLVAVPTPRLLCPLY

SEQ ID NO: 3 - protein, 506 aa, Cichorium endivia
  UNSURE 328: Unknown
  UNSURE 405: Unknown
MDYLQIPIPIYAIIAILTFFFLAWLRRKPLPPGPMGWPIIGNMLMMDQLTHRGLASLANKYGGILHLKMGFSHTIAVSSPEIARQILQEKDNIFANRPATIAITYLTYNRVDMAFANYGPFWRQMRKLCVMKLFSRKRAESWDSVRDEVDTMVKATATNSGLPVNLGELVFGLTHDIIYRAAFGSISHEGKEEFIRILQEYTKLFGAFNLADFIPMLGFIDPAGLNTRLPAARAALDGFIDKIIDEHLSKEKKTGDENVDNDMVDEMLAFYSEDGRINEGGDLQNAINLTRDNIKAIIMDVMFGGTETVASAIEWTMTELMHTPEALXRVQQELTNVVGLDRRVEESDFEKLTYFKCVIKETLRMHPPIPVLLHQSSEATEVSGYHIPKGTRVMVNAYAINRDKXSWEDPDTFNPSRFLQNGAPDFRGSNYEFLPFGSGRRSCPGMQLGLYAMEMAVAHLLHCFTWDLPDGMKPSEIDMGDVFGLTAPKAIRLVAVPTPRLLCPLY

SEQ ID NO: 4 - protein, 506 aa, Cichorium endivia
MDSLQIPIPVYAIIAILTFFFLAWLRRKPLPPGPIGWPIIGNMLMMDQLTHRGLASLAKKYGGILHLKMGFSHTIAVSSPEIARQILQEKDNIFANRPATIAITYLTYNRVDMAFANYGPFWRQMRKLCVMKLFSRKRAESWDSVRDEVDTMVKATAINSGLPVNLGELVFGLTHDIIYRAAFGSISHEGKEEFIRILQEYTKLFGAFNLADFIPMLGFIDPAGLNTRLPAARAALDGFIDKIIDEHLSKEKKTGDENVDNDMVDEMLAFYSEDGRVNEGGDLQNAINLTRDNIKAIIMDVMFGGTETVASAIEWTMTELMHTPEALKRVQQELTNVVGLDRRVEESDFEKLTYFKCVIKETLRMHPPIPVLLHQSSEATEVSGYHIPKGTRVMVNAYAINRDKNSWEDPDTFNPSRFLQNGAPDFRGSNYEFLPFGSGRRSCPGMQLGLYAMEMAVAHLLLCFTWELPDGMKPSEIDMGDVFGLTAPKAIRLVAVPTPRLLCPLY

SEQ ID NO: 5 - protein, 503 aa, Cichorium endivia
MDPMSILLYVVLPLFTFFLLSRFRRKPLPPGPRGWPVIGNMLMMDQLTHRGLARLGEKYGGLLHLKMGFSHTVAVSSPEIARQVLQVQDNIFANRPATIAISYLTYDRQDMAFANYGPFWRQMRKLCVMKLFSRKRAESWDSVRDEVVSMIKITAASSGSAVNLGELVFGLTHDIIYRAAFGSISHEGKEEFIRILQEYTKLFGAFNLADFIPWLGFIDPAGLNNRLPKARAALDGFIDKIIDEHLRKEKKTGDEEDNDMVDEMLAFYSEEGKVNEGEDLQNAIRLTRNNIKAIIMDVMFGGTETVASAIEWALTELMHTPESLKRAQQELVDVVGLDRRVEESDFEKLTYFRCVIKETLRLHPPIPVLLHQSSEATEVAGYHIPKGTRVMVNAFAINRDKNSWKDPHTFNPSRFLQDGAPDFKGSNYEFLPFGSGRRSCPGMQLGLYAMEMAVAHLLHSFTWQLPDGMKPSEIDMSDVFGLTAPKAIRLVAVPTPRLLCPLY

SEQ ID NO: 6 - protein, 506 aa, Cichorium intybus
MDSLQIPIPVYAIIAVLTFVFVAWLRRKPLPPGPMGWPIIGNMLMMDQLTHRGLASLAKKYGGILHLKMGFSHTIAVSSPEIARQILQEKDNIFANRPATIAITYLTYNRVDMAFANYGPFWRQMRKLCVMKLFSRKRAESWDSVRDEVDTMVKATATNSGLPVNLGELVFGLTHDIIYRAAFGSISHEGKEEFIRILQEYTKLFGAFNLADFIPMLGFIDPAGLNTRLPAARAALDGFIDKIIDEHLSKEKKTGDENVDNDMVDEMLAFYSEDGRINEGGDLQNAINLTRDNIKAIIMDVMFGGTETVASAIEWTMTELMHTPEALKRVQQELTNVVGLDRRVEESDFEKLTYFKCVIKETLRMHPPIPVLLHQSSEATEVSGYHIPKGTRVMVNAYAINRDKNSWEDPDTFNPSRFLQNGAPDFRGSNYEFLPFGSGRRSCPGMQLGLYAMEMAVAHLLHCFTWELPDGMKPSEIDMGDVFGLTAPKAIRLVAVPTPRLLCPLY

SEQ ID NO: 7 - protein, 506 aa, Cichorium intybus
MDSLQIPIPVYAIIAILTFFFLAWLRRKPLPPGPMGWPIIGNMLMMDQLTHRGLASLAKKYGGILHLKMGFSHTIAVSSPEIARQILQEKDNIFANRPATIAITYLTYNRVDMAFANYGPFWRQMRKLCVMKLFSRKRAESWDSVRDEVDTMVKATAINSGLPVNLGELVFGLTHDIIYRAAFGSISHEGKEEFIRILQEYTKLFGAFNLADFIPMLGFIDPAGLNTRLPAARAALDGFIDKIIDEHLSKEKKTGDENVDNDMVDEMLAFYSEDGRVNEGGDLQNAINLTRDNIKAIIMDVMFGGTETVASAIEWTMTELMHTPEALKRVQQELTNVVGLDRRVEESDFEKLTYFKCVIKETLRMHPPIPVLLHQSSEATEVSGYHIPKGTRVMVNAYAINRDKNSWEDPDTFNPSRFLQNGAPDFRGSNYEFLPFGSGRRSCPGMQLGLYAMEMAVAHLLHCFTWELPDGMKPSEIDMGDVFGLTAPKAIRLVAVPTPRLLCPLY

SEQ ID NO: 8 - protein, 503 aa, Cichorium intybus
MDPMSILLYVVLPLFTFFLLSRLRRKPLPPGPRGWPVIGNMLMMDQLTHRGLARLGEKYGGLLHLKMGFSHTVAVSSPEIARQVLQVQDNIFANRPATIAISYLTYDRQDMAFANYGPFWRQMRKLCVMKLFSRKRAESWDSVRDEVISMIKITAASSGSAVNLGELVFGLTHDIIYRAAFGSISHEGKEEFIRILQEYTKLFGAFNLADFIPWLGFIDPAGLNTRLPKARAALDGFIDKIIDEHLSKEKKTGDEEDNDMVDEMLAFYSEEGKVNEGEDLQNAIRLTRNNIKAIIMDVMFGGTETVASAIEWALTELMHTPESLKRAQQELADVVGLDRRVEESDFEKLTYFRCVIKETLRLHPPIPVLLHQSSEATEVAGYHIPKGTRVMVNAFAINRDKNSWKDPHMFNPSRFLQDGAPDFKGSNYEFLPFGSGRRSCPGMQLGLYAMEMAVAHLLHSFTWQLPDGMKPSEIDMSDVFGLTAPKAIRLVAVPTPRLLCPLY

SEQ ID NO: 9-10 - skipped (2 entries)

SEQ ID NO: 11 - protein, 502 aa, Apium graveolens
MSLLFILLLTIISMIFFISRFGGKPYPPGPRRLPVIGNTLMMACLTHRGLAKLASRYGGLFYLRMGAQDIVVVSTPDMARQILQTHQDQISNRPTSIALDYLSYGRANMAFADYSPWWRQMRKICVMKLFSRARVESWNSVRDELNHMLRDVASNANQAINLGELVFGFTEKIIYRAAFGSRLSDGGTEFIKIMQEFSKLFGSFNVCDFVPWMSRADPQGLKARLRKARGSLDTFIDSIIDQHIIKRKGKNIGDKDMVDELLAFYTEEGEAKAESDDLQATIKLTKNNIKGIIMDIMFGGTETVAAAIEWAMSELLKNPEELRKTQEELSNVVGLHRCVEEGDLEKLTYLKCVLKETLRLHPPLPFLPRAAAEDVYVAGYYIPAGSRVIINLWAMGHDGKCWNDEPEAFKPSRFLDVGAPDYRNNNFEFIPFGTGRRSCPGMQLGLHAFEMGLAHLLHCFNWELPDGMKPSQVDMSDMYGLSAPKATRLIAVPTPRLLCPIC

SEQ ID NO: 12 - protein, 501 aa, Apium graveolens
MTTIFFFLLLLCLFLARRKPYPPGPKGWPIIGNMLIMDKLTHRGLAKIATQYGGIVHLRMGFLHMVTVSTPDMVREVLQIQDTVFANRPATMNISYLTYNRADMAFANYGPFWRQMRKISIIKLFSRKRAESWDSVRDQVDDMLGKVVSNSGLSVNIGELVFGLTRNIIYRAAFGSISGQGQDEFIKIMQEFSKLFGAFNICDFVPGITWLDPQGFKVRLVKARESLDKFIDSILDEHIANQKSNLNGSTDEGNGDMVYQLLAFYSEEQSKVNHSDDTNNALKLTRDNIKAIIMDVMFGGTETVASAIEWAMSELMGSPEDLKRVQQELIDVVGLHRRVEENDFDKLIYLKCCIKETLRLHPPIPLLLHETAQEAVVAGYHIPAKSRVMINSWAVNRDPNSWDDPEKFKPSRFLKQGMPDFKGSNFEFIPFGSGRRSCPGMQLGLYAFEMAVAHLLHSFNWELPDGMKPSELDTNDVFGLTAPRATRLVAVPTPRLLCSIC

SEQ ID NO: 13 - protein, 511 aa, Apium graveolens
METNTTAMTILFFILPLLSFFLLSSFRRKRYPPGPKGWPIIGNLLMMDKLSHRGLAKLAAQYGGLVHLRMGFLHMFTVSTPDMAREVLQIQDNIFANRPATMNISYLTYDRADMAFANYGPFWRQMRKISVMKLFSRKRAESWDSVREEVDDMVKIVLSKTGCSVNIGELVFGLTRNIIYRAAFGTLSHEGQDEFIKILQEFSKLFGAFNICDFVPGLTWADPQGFMGRVVKARASLDGFIDSIIDAHIEKKKSSKNGIIDEGNSDMVYELLDFYGEEKAKVSEFEDQNSSLKLTRDNIKAIIMDVMFGGTETVASAIEWAMSELMRSPKDLKKVQQELVNVVGLHRRVEESDFDKLTYLKCCIKETLRLHPPIPLLLHETAQDAEVAGYHIPARSRVIINSWAINRDPNSWTDPDTFKPSRFLQEGMPDFKGSNFEFIPFGSGRRSCPGMQLGLYALEIAVAHLLHCFNWELPDGMKPSEVDTDDVFGLTAPRATRLVAVPTPRLLCPIS

SEQ ID NO: 14 - protein, 520 aa, Brassica oleracea
MESSISQTLSQVLDPTTGILIVVSLFIFIGLITRGRRPPYPPGPRGWPIIGNMSMMDQLTHRGLANLAKKYGGLCHLRMGFLHMYAVSSPDVARQVLQVQDSVFSNRPATIAISYLTYDRADMAFAHYGPFWRQMRKVCVMKVFSRKRAESWASVRDEVDRMIRSVSSNVGKSINVGEQIFALTRNITYRAAFGSACEKGQDEFIRILQEFSKLFGAFNVADFIPYFGWIDPQGINKRLVKARNDLDGFIDDIIDEHIKKKENQNSIDAGDVVDTDMVDDLLAFYSEEAKLVSETADLQNSIKLTRDNIKAIIMDVMFGGTETVASAIEWALTELLRSPEDLKRVQQELAEVVGLDRRVEESDIEKLTFLKCTLKETLRLHPPIPLLLHETAEDTEIDGYFVPKKSRVMINAFAIGRDKNSWVDPETFRPSRFLEPGVPDFKGSNFEFIPFGSGRRSCPGMQLGLYALELAVAHILHCFTWKLPDGMKPSELDMSDVFGLTAPKATRLYAVPSTRLICSV

SEQ ID NO: 15 - protein, 519 aa, Brassica oleracea
MESSVSQTLSQVLDPTTAILIVVSLFIFIGLITRRRRSYPPGPRGWPIIGNMLMMDQLTHRGLANLAKKYGGLCHLRMGFLHMYAVSSPDVARQVLQVQDSIFSNRPATIAISYLTYDRADMAFAHYGPFWRQMRKVCVMKVFSRKRAESWASVRDEVDKMIRSVSSNVGKSINVGEQIFALTRNITYRAAFGSACEKGQDEFIRILQEFSKLFGAFNVADFIPYFGWIDPQGINKRLVKARNDLDGFIDDIIDEHMKKKENQNTVDDGYVGDTDMVDDLLAFYSEEAKLVSETTDLQNSIKLTRDNIKAIIMDVMFGGTETVASAIEWALTELLRSPEDLKRVQQELAEVVGLDRRVEESDIEKLTFLKCTLKETLRLHPPIPLLLHETAEDTEIDGYFVPKRSRVMINAFAIGRDPKSWPDAETFRPSRFLEPGVADFKGSNFEFIPFGSGRRSCPGMQLGLYALELAVAHILHCFTWKLPDGMKPSELDMNDVFGLTAPKATRLFAVPSTRLICAV

SEQ ID NO: 16 - protein, 512 aa, Brassica oleracea
MDCLLCSPILYVVLIFLWYLVRVLLTRSNPFPPGPKGYPIIGNMKLKNQLNHRGLAELAKQYGGLLHLQMGRIHIVAASTAEMAREILQVQDVVFANRPANVAISYLTYNRADMAFANYGPLWRQMRKVCVMKLFSRKRAESWASVRDEINTMVQTLTKQTGSPVNVGELVFALTRNITYRAAFGSFARDGQDEFVKILQEFSKLFGAFDITEFLPWMKWFSNRDFSKRLENARKSLDGFIDRIIDAHIEKKNSRKQDDDGLEDDMVDELMAFYSGESGENGGKSNDSLSSFKLTRDNIKALVMDVMFGGTETVASAIEWAMTELMKNPHELVKLQQELADVIGLNREFHESDLENLPYFRCAMKETLRLHPPIPLLLHEAAADSVVSGYSIPRDSRVMINVYAIGRDGSVWTEPDAFRPGRFMDSKAPDFKGSDFEFLPFGSGRRSCPGMQLGLYAMELAVAHMLHSFDWELPEGGSSDDLDMTDMFGLTAPRATRLIAVPSYRLKCPMVI

SEQ ID NO: 17 - protein, 514 aa, Brassica oleracea
MESLLSQTLNQVIDPTPSVLLITISLLVVVYLISQWFKPLYPPGPKGLPVIGNMLMMDQLTHHGLAKLAHKYGGLFHLRMGFRHVFAITSPDVARQVLQVQDISFSNRPVNVAINYLTYDLADMAFAPYGPFWREMRKVCVMKVFSRKRTESWASVREEVNNMVRSFSSNVGKPVNVGELIFTLTRNITYRAAFGAACETEQDEFIRILQEFSKLFGAFNIADFIPFLGWFDFQGINKRLVKARNDLDGFIDEVIDEHMKKRETVNVDEDTDMVDDLLAFYSEDSSTNRNKNTVKLTRDNIKALVMDVMFGGTETMASGIEWALTELLRNPAELKRLQQELTEVVGLDRRVDDTHLEQLTFLKCTLKETMRLHPPIPLILHEAIEDRKLQGFFVPKGSRLMINAFAIARDPKLWVDPEAFRPSRFMEPGMPDFMGTNFEFIPFGAGRRSCPGMQLGLYAMEVAVANIIHCFTWKLPDGMKPSELDMSDVMGLTAPRATRLIAVPDTRLICPVYP

SEQ ID NO: 18 - protein, 517 aa, Brassica oleracea
  UNSURE 401: Unknown
MYTLMTLILLVPLLLFLFRHLLSRRLRQRKPYPPGPKGLPIIGNILMMNQFNHRGLAKLSRTYGGLLHLRLGISHLFVVSSPQIARQVLQVQDHVFSNRPTTIAIRYLTYGQSDLAFCNYGPFWRRMRKLYVMMLFSRKRAESWASVDEEVHKAVRSVAANVGKPLNVCKVAFSLTRDITFRAAFGSSSSSSNEGRLDEFLEIIQEFSKLFGEFNVADYVPSWLSWIDPQGINKRVEKARKSLDCFIESIINDHLDKKKTEKNVNVDEVTDMVDQLLAFYKEEVKVKDSETKINLDNIKGIIMDVMFGGTETVALAIEWVLTELLRSPENMKRVQDELATVVGLERWSVEDTHLEKLSFLKCVLKDTLRLHPPFPLLLHETVEEAEVSGYFIPKGSRVMVXTYALGRDPASWSDPEIFNPSRFLDPGAPDLKGNSFEFIPFGSGRRSCPGMQLGMYAFELAVAHLLHCFTWRLPDGVKFGDVDTIEGPGLTVAKANSLVAVPIKRLLCPMVLESHNV

SEQ ID NO: 19 - protein, 524 aa, Solanum melongena
MKEMVQKNINSILEALQANPMLLFLFIIPLFFLYLFSTSSRRRYPPGPRGWPLIGNMMIMDQLTHRGLAKLAEKYGGVMHLKMGYIHKIVISGPEEARQVLQVQDNIYSNRPATVAISYLTYDRADMAFADYGPFWRQMRKLCVMKLFSRKRAESWDSVRDEVDSLIKIVTTNAGTSVNLGELVFGLTRDIIYRAAFGTSSAEGQEEFIKILQEFSKLFGAFNMVDFIPWLGWIGQQGLNVRLANARASLDGFIDSIIDDHIERKKANVTIDNGDRETDMVDELLAFYSEEATVNESEDNLQNAIRLTRDNIKAIIMDVMFGGTETVASAIEWVMAELVKNPEELKKVQQELANVVGLNRRVEESDLEKLTYLKCCLKETLRLHPPIPLLLHETAEESTIFGYHIPAGSHVVINSFAIGRDKNSWEDADSYKPSRFLKQGVPDFKGGNFEFLPFGSGRRSCPGMQLGLYALEMAVAHLLHCFTWELPDGMKPSELKMDDTFGLTAPLANRLVVVPSPRLLCTLY

SEQ ID NO: 20 - protein, 524 aa, Solanum melongena
MKEIIQNNTFFILTTKETNLMMPLYFIFPIFIFFFFTISRLNKKNFPPGPKGWPIIGNMMMMDQLTHHGLAKLAKKYGGILHLQMGYLQMTVVSSPAEAREVLQLQDTIFANRPTTIAVEYLSYARADMAFANYGPFWRQMRKLCVMKLFSRKRAESWDSIRDEVESMTMAVATRVGSSVNIGELVFGVAKNIIYRAAFGTCSNRGQDELLNIMQEFSKLFGAFNLADFIPWLGWVDPQGLNKMIIKARASLDGFIDTIIDDHIQRKKTNNYNDEGNNNDMVDELLAFYGEKTKLNDSDDLTNALRLTRDNIKSIIMDIMFGATETVASAIEWAMAELMKSPEDLKMVQQELANVVGLHRKVEEMDFEKLIFLKCCIKETLRLRPPIPLLVHESVEDTTINNYYIPAKSRVIVNAWAIGRDKNSWDDPESFKPSRFLKEGVADFKGGDFEFLPFGSGRRSCPGMQMGLYAFEMTLAHLLHCFNWELPNGMKPSDIDMNDVFGLTVPKATRLVAVPTPRLLCQLY

SEQ ID NO: 21 - protein, 522 aa, Solanum tuberosum
MKEMVLNNINSTLEALQAQPMLLFFFIIPLFFLYLFSTSRRKRYPPGPLGWPLIGNMMMMDQLTHRGLAKLAQKYGGVFHLKMGYVHKIVISGPEEARQVLQVQDNIYSNRPKTVAISYLTYDRADMAFADYGPFWRQMRKLCVMKLFSRKRAESWDSVRDEVDSMVKIVTTNTGTSINLGELVFCLTRNIIYRAAFGTSSDEGQDDFIKILQEFSKLFGAFNMADFIPWLRWIGQQGLNVRLAKARASLDGFIDSIIDDHIERKKANVINDDGYRESDMVDELLAFYSEETKVNESEDLQNSIRLTRDNIKAIIMDVMFGGTETVASAIEWAMAELMKSPEDLKKVQQELANVVGLNRKVDESDFEKLTYLKCCLKETLRLHPPIPLLLHETAEESTVSGYYIPAKSHVIINSFAIGRDKNSWEDPDSFKPSRFLKEGVPDFKGGNFEFLPFGSGRRSCPGMQLGLYALEMAVAHLLHCFTWELPDGMKPSELKMDDIFGLTAPLANRLVAVPTPRLLCNY

SEQ ID NO: 22 - protein, 516 aa, Malus domestica
  UNSURE 318: Unknown
MDYLLQSLQPLQSMTPLLLIIPLLFLLPLIFRFRRPPPYPPGPKGLPLIGNMLLMDQLTHRGLAKLAKKYGGIFHLRMGFLHMVAISNPDVARQVLQVQDNIFSNRPATIAISYLTYDRADMAFAHYGPFWRQMRKLCVMKLFSRKRAESWESVRDEVDSSVRTVTVHVGSAVNIGELVFSLTKNIIYRAAFGTSSQEGQDEFIGILQEFSKLFGAFNIADFIPSLGWVDPQGLNNRLAKARESLDRFIDTIIDDHMEKKRNGKGVSDGETDMVDELLAFYSEEAKVYESEDNLQNAIKLTRDNIKAIIMDVMFGGTXTVASAIEWAMSELMKSPEDLKRVQQELADVVGLDRRPEETDFEKLTYLKCALKETLRLHPPIPLLLHETSEDAVVAGYRIPKRSRVMINAWAIGRDKDSWEDAESFKPSRFLKEGVPDFKGSNFEFIPFGSGRRSCPGMQLGLYALEMAVAHLLHCFTWELPDGMKPSELDMNDVFGLTAPRASRLIAVPSKRVVCPL

SEQ ID NO: 23 - protein, 517 aa, Malus domestica
MDSLLQSLQPLKSMTPLVFIIPLLFLLPLIFCFRRRPPYPPGPKGLPLFGNMLMMDQLTHRGLAKLAKQYGGIFHLRMGFLHMVAISNPDVARQVLQVQDNIFSNRPATIAISYLTYDRADMAFAHYGPFWRQMRKLCVMKIFSRKRAESWESVRDEVDTAVRTVTVHVGSAVNIGELVFSLTKNIIYRAAFGTSSQEGQDEFIGILQEFSKLFGAFNIADFIPSLGWVDPQGLNNRLAKARESLDRFIDTIIDDHMEKKKKNNKGLNDGETDMVDDLLAFYSEEAKVNESEDNLQNAIKLTRDNIKAIIMDVMFGGTETVASAIEWAMSELMKNPEDLKRVQQELLNVVGLDRRPEEADFEKLTYLKCALKETLRLHPPIPLLLHETSEDAVVAGYHIPKKSRVMINAWAIGRDKDSWEDPESFKPSRFLKEGVPDFKGSNFEFIPFGSGRRSCPGMQLGLYALEMAVAHMLHCFTWELPDGMKPSELDMNDVFGLTAPRASRLVAVPSKRVVCPL

SEQ ID NO: 24 - protein, 519 aa, Malus domestica
MELLHQALQSLQSSPMLLILLLLLLIISFIFLFNSRRKPPYPPGPKGWPIIGNMLMTDQLTHRGLAHLAKQYGGLLHLQMGVIHVMAVSTPDMAREILQSQDSLFANRPANVAISYLTYDRADMAFANYGPFWRRMRKICVINLFSRKRAESWASVREEVDEMVQTVAGKTGSPVNIGQLVFALTRNITYRAAFGSSSHEGQGEFVQILQEFSKLFGAFNMQDFLPWLGWVHAQGFQDRMARARKSLDVFIDKIIDDHMAKRKANMEKDDSEAADTDMVDELIAYFSDDAGKEGDDPNSGFKLTRDNIKALIMDVMFGGTETVASVIEWTMAELMKSPEDLKRVQQELTDVVGLNRRLQETDLENLTYLKCAVKESLRLHPPIPLLLHETVEDTSVAGYSFPAGSRVWINAWAIARDPTAWDEPETFKPSRFLEDSSPDFKGSNFEFIPFGSGRRSCPGMALGLYGLEMAVAHLLHCFAWELPGGMKPSELDMNDVFGLTAPKAVQLVAVPTYRLNCPL

SEQ ID NO: 25 - protein, 516 aa, Pyrus x bretschneideri
MDSLLQSLQALQSMTPLLLIIPLLFLLPLIFRFRRPPPYPPGPKGLPLIGNMLLMDQLTHRGLAKLAKKYGGIFHLRMGFLHMVAISNPDVARQVLQVQDNIFSNRPATIAISYLTYDRADMAFAHYGPFWRQMRKLCVMKLFSRKRAESWESVRDEVDSAVRTVTVHVGSAVNIGELVFSLTKNIIYRAAFGTSSQEGQDEFIGILQEFSKLFGAFNIADFIPSLGWVDPQGLNNRLAKARESLDRFIDTIIDDHMEKKRNGKGVSDSETDMVDELLAFYSEEAKVNESEDNLQSAIKLTRDNIKAIIMDVMFGGTETVASAIEWAMSELMKSPEDLKRVQQELADVVGLDRRPEETDFEKLTYLKCALKETLRLHPPIPLLLHETSEDAVVAGYRIPKRSRVMINAWAIGRDKDSWEDAESFKPSRFLKEGVPDFKGSNFEFIPFGSGRRSCPGMQLGLYALEMAVAHLLHCFTWELPDGMKPSELDMNDVFGLTAPRASRLIAVPSKRVVCPL

SEQ ID NO: 26 - protein, 516 aa, Pyrus x bretschneideri
MDSLLQSLQPLQSMTPLLLIIPLLFLLPLIFRFRRPPPYPPGPKGLPLIGNMLLMDQLTHRGLAKLAKKYGGIFHLRMGFLHMVAISSPDVARQVLQVQDNIFSNRPATIAISYLTYDRADMAFAHYGPFWRQMRKLCVMKLFSRKRAESWESVRDEVDSAVRTVTVHVGSAVNIGELVFSLTKNIIYRAAFGTSSQEGQDEFIGILQEFSKLFGAFNIADFIPSLGWVDPQGLNNRLAKARESLDRFIDTIIDDHMEKNRNGKGVSDSETDMVDELLAFYSEEAKVNESEDNLQSAIKLTRDNIKAIIMDVMFGGTETVASAIEWAMSELMKSPEDLKRVQQELADVVGLDRRPEETDFEKLTYLKCALKETLRLHPPIPLLLHETSEDAVVAGYRIPKRSRVMINAWAIGRDKDSWEDAESFKPSRFLKEGVPDFKGSNFEFIPFGSGRRSCPGMQLGLYALEMAVAHLLHCFTWELPDGMKPSELDMNDVFGLTAPRASRLIAVPSKRVVCPL

SEQ ID NO: 27 - protein, 516 aa, Pyrus x bretschneideri
MDSLLQSLQPLKSMTPLVFIIPLLFLLPLIFRFRRLPPYPPGPKGLPLIGNMLMMDQLTHRGLAKLAKQYGGIFHLRMGFLHMVAVSNPDVARQVLQVQDNIFSNRPATIAISYLTYDRADMAFAYYGPFWRQMRKLCVMKLFSRKRAESWESVRDEVDSAVRTVTVHVGSAVNIGELVFSLTKNIIYRAAFGTSSQEGQDEFIAILQEFSKLFGAFNIADFIPSLGWVDPQGLNNRLAKARESLDRFIDTIIDDHMEKKKNNKGLNDGETDMVDELLAFYSEEAKVNESEDNLQSAIKLTRDNIKAIIMDVMFGGTETVASAIEWAMSELMKSPEDLKRVQQELADVVGLDRRPEETDFEKLTYLKCALKETLRLRPPIPLLLHETSEDAVVAGYRIPKRSRVMINAWAIGRDKDSWEDAESFKPSRFLKEGVPDFKGSNFEFIPFGSGRRSCPGMQLGLYALEMAVAHLLHCFTWELPDGMKPSELDMNDVFGLTAPRASRLIAVPSKRVVCPL

SEQ ID NO: 28 - protein, 517 aa, Pyrus x bretschneideri
MDSLLQSLQPFTSMTPLVFIIPLLFLLPLIFRFRRLPPYPPGPKGLPLIGNMLMMDQLTHRGLAKLAKQYGGIFHLRMGFLHMVAVSNPDVARQVLQVQDNIFSNRPATIAISYLTYDRADMAFAHYGPFWRQMRKLCVMKLFSRKRAESWESVRDEVDTAVRTVTVHVGSAVNIGELVFSLTKNIIYRAAFGTSSQEGQDEFIAILQEFSKLFGAFNIADFIPSLGWVDPQGLNNRLAKARESLDRFIDTIIDDHMEKKKNNNKGLNDGETDMVDDLLAFYSEEAKVNESEDNLQNAIKLTRDNIKAIIMDVMFGGTETVASAIEWAMSELMKSPEDLKRVQQELFNVVGLDRRPEEADFEKLTYLKCALKETLRLHPPIPLLLHETSEDAVVSGYHIPKQSRVMINAWAIGRDKDSWEDPESFKPSRFLKDGVPDFKGSNFEFIPFGSGRRSCPGMQLGLYALEMAVAHMLHCFTWELPDGMKPSELDMNDVFGLTAPRASRLVAVPSKRVVCPL

SEQ ID NO: 29 - protein, 519 aa, Pyrus x bretschneideri
MELLRQALQSLQSSPMLLILLLLLVISLIFLFNSRRKLPYPPGPKGWPIIGNMLMTDQLTHRGLAHLAKQYGGLLHLQMGAIHVIAVSTPDTAREILQVQDSSFANRPANIALSYLTYDRADMAFANYGPFWRRMRKICVINLFSRKRAESWASVREEVNEMVQTVAGKTGSPVNIGQLVFALTRNITYRAAFGSRSHEGQGEFVKILQEFSKLFGAFNMQDFLPWLGWVHAQGFQDRMARARKSLDVFIDKIIDDHMAKRKANTENKDDSEAADTDMVDELIAYFSDDAGKEGDDPNSGFKLTRDNIKALIMDVMFGGTETVASVIEWTMAELMKSPEDLKRVQQELTDVVGLNRRLQETDLENLTYLKCAVKESLRLHPPIPLLLHETVEDTSVAGYSFPAGSRVWINAWAIARDPTAWDEPETFKPSRFLDDGSPDFKGSNFEFIPFGSGRRSCPGMALGLYGLEMAVAHLLHCFAWELPGGMKPSELDMNDVFGLTAPKAVQLVAVPTYRLNCPL

SEQ ID NO: 30 - protein, 520 aa, Prunus persica
MDDLLLHQALESLQSSPMLFILLFLLIISWFVLFMSRRKLPYPPGPRGWPIIGNMLMMDQLTHRGLAQLAKQYGGLLHLQMGVLHIMVVSSPKVAREILQVQDSSFANRPANAAISYLTYDRADMAFANYGPFWRRMRKICVINLFSRKRAESWASVREEVEEMVRHVATKTSSPVNIGQLVFTLTKNITYRAAFGSSSHEGQGEFVKILQEFSKLFGAFNMQDFLPWLGWVHAQAFKDRMAKARRSLDVFIDKIIDDHMAKRNTNKAKKDDNEAETDMVDELIAFFSDDAAKESDDPNSTFRLTRDNIKAIIMDVMFGGTETVASVIEWTMAELMKSPEDLQKVQQELINVVGLNRRVQETDLENLTYLKCAVKESLRLHPPIPLLLHETAEETSVAGYSFPVGSRVYINAWAIARDPTAWDEPETFKPSRFLKDGSPDFKGSDFEFLPFGSGRRSCPGMQLGLYGLEMAVAHLLHCFAWELPEGMKPNELDMNDVFGLTAPKAVQLVAVPSYRLNCPL

SEQ ID NO: 31 - protein, 519 aa, Prunus persica
MDSLLQALQPLQPMTLFFIIPFLFLSGLVFLYRSRRRSPYPPGPTGLPIIGNMLMMDQLTHRGLAKLAKQYGGIFHLRMGFLHMVGISNPDVARQVLQVQDNIFSNRPATIAISYLTYDRADMAFAHYGPFWRQMRKLCVMKLFSRKRAESWDAVRDEVDTAVRTVAVQAGSAVNIGELVFSLTKNIIYRAAFGTSSEEGQDEFIGILQEFSKLFGAFNIADFIPCLGWVDPQGLNNRLARARQSLDRFIDSIIDDHIQKKKKKKSEGSNGGETDMVDELLAFYSDEAKVNESDDNLQNAINLTRDNIKAIIMDVMFGGTETVASAIEWAMAELMRNPEELKRVQQELADVVGLDRRPEEGDFEKLTYLKCALKETLRLHPPIPLLLHETAEDAEVAGYHIPKKSRVMINSWAIGRDKDSWEDAESFKPSRFLKEGVPDFKGSNFEFLPFGSGRRSCPGMQLGLYSLELAVGHLLHCFTWELPDGMKPSELDMNDVFGLTAPRASRLIAVPSKRVVCPL

SEQ ID NO: 32 - protein, 516 aa, Musa acuminata
MEWSEEVTPLHFMVCFALPLVLLYVVATRRRGKLPFPPGPPQLPVIGNMLMMDQLTHRGLAKLGEHYGGLCHLRLGFLHAFAVSTPEIARQVLQVQDNVFSNRPATIAISYLTYNRADMAFAHYGPFWRQMRKLCVMKLFSKKRAESWASVREEVDVAVRSLADRAGSAVNVGELLFNLTKNIIFRAAFGTQSHENQNEFISILQEFSKLFGSFNIGDFIPWLSWMDPQGINKRLKVARASLDRFIDKIIDEHMANRKEADASDADMVDDMLAFLDESGYRCQAGERDDLQGTLKLTRNNIKAIIMDVMFGGTETVASAIEWAMAELMKSPEDMKRVQQELAHVVGLDRKVHESDLDKLSFLKCVTKETLRLHPPIPLLLHETAEDCEVAGYTVPARSRVMINVWAIGRDKSSWEDADAFRPSRFTPGGCAASLDFKGNYFEFLPFGSGRRSCPGMQLGLHALELAVAQLIHCFTWTLPDGMKPSELDMGDVFGLTAPRAVRLAAVPAPRLSCPLY

SEQ ID NO: 33 - protein, 516 aa, Musa acuminata
MEWLEEVTSMRFVVCVVVPVTLLLAASTRWRRKLPFPPGPTPLPIVGNMLMMGQLTHRGLAKLSERFGGLCHLRLGFVHVFAVSTSEIARQVLQVQDAVFSNRFATIAITYLTYDRADMAFAHYGPFWRQMRKLCVMKLFSKKRAVSWASVREEVDAAVRAVTDGAGAAVNLGELMFNLTKNITFRAAFGTQSHENQEEFIAILQEFSLLFGAFNIGDFIPWVSWMDLQGINKRFKVAREALDGFIDKIIEEHMANPKEADAEDSDMVDEMLAFFEESRDRTKENEADELQRTLRLTRNNIKAIIMDVMFGGTETVASAIEWAMAELMKNPEDMRRVQEELASVVGLHRKVRESDLDKLPHLKCAVKETLRLHPPIPILLHETAEDCQLTGYAVPARSRIMINVWAIGRDKSAWEDAEVFRPSRFAPGGEAAALDFKGGCFEFLPFGSGRRSCPGMQLGLHALELAVAQLTHCFSWELPDGMKPGELDMGDMFGLTAPRAVRLVAVPTPRLTCPLY

SEQ ID NO: 34 - protein, 515 aa, Musa acuminata
MVWVEEVTSMHLILLCLMLPLTLLLIVNIAARRRRRLPLPPGPTPLPIIGNMLLMNQLTHRGLARLAKLYGGLLHLRLGFVHHFVVSTPDVARQVLQVQDSVFSDRPATTAIVYLTYNRSDLAFAQCGPYWRQMRKLCVTKLFSRKHAESWLSIPEEVDAAVCTVAKHAGSAFNVRDLAFTLTKNIVFRSAFGKRSDENQEEYIAVVQEIATLLGAFSVGDFIPWLSWMDPQGINKRLRVARATLDLFIDRIIDEHMATDAANADMVGVMLAFLEESSHHHRQEEGDDLKGTLRLSRANIRAVMMDVMFGGTETVAIAIEWALADLLTSPDDLKRVQEELAMVVGLDRKVHESHLDKLSFLKCAIKETLRLHPPFPLLLHQTADHCEVAGYSIPARSPVMINVWAIGRDESAWKDADAYRPSRFAPGGDAAALDFKGNCFEFLPFGSGRRSCPGMQLGMHELELAVAQLLHCFTWALPDGMKPTELDMGDVFGLSAPKAVPLVAVPTPRLSCPLN

SEQ ID NO: 35 - protein, 511 aa, Musa acuminata
MDWFHQLSFMVASVFIPLALLSFFCMRSGRKLLLPPGPQPLPIIGNMLMMDQLTHRGLARLAERYGGLFHLRLGSLHAVVVSTPEMARLVLQVQDASFCNRPVTAAIAYLTYDRADMAFANYGPFWRQTRKLCVMKLFSRRRLQSWASVRQEVDSAVRFAARRSGSSVDVGDLAFTLAKNVTFMAAFGAQSHGNQGEFAGILQEYSKLFGEFNISDFLPWLRWMDLQGIDKRLKVARQAIDRYIDVIIDDHLANPKEADAQDADMVDGMLAFLGDSGDTNEGGDLHGDLSLTRSNIKAIIMDVMFGGTETVALGIEWAMAELLKSPEELKRTQQELASVVGLHRKVDDSDLDKLPYLKCAVKEMLRLHPPLPLLQHQATQDCELAGYFIPVGTRVFVNAWGIGRDRDAWKSPNAFRPSRFALGGDAAAFDFRGSCFELLPFGSGRRSCPGMQLGLYVLELAVAQLLHCFDWSLPAGTKPGDLDMGDVFGLTAPKAVRLMAVPTPRLTCPLL

SEQ ID NO: 36 - protein, 509 aa, Triticum aestivum
MATFAKIAMELLADPLMWLFLASLALVAMQRRRLGSAPFPPGPKPLPVIGNMTLVDQLTHRGLAALAKQFGGLLHLRFGWLHVLAVSTPEYAREVLHAQDGVFSNRPATIAVVYLTYGRDMAFAHNGAYWRQMRKLCVTKIFSRRRAETWLAVREGYGALAREVGRRSGEAVNLGELIFNLTVSVIFRAAFSTCDEDGLIEFIAILQEFSRLLGLFHIGDFFPWLAWVGRRGFNRRLSTARGALDRFIDKIVDEHMRRGKDPADPDADLVDGLLGFLADANPREDALRFTRDNVKAMIMDMLFGGPETVGSTTEWAMAEMMRSPDELERLQQELADVVGLDRAVEESDLDKLPFLRCVVKEALRMHPPIPVLLHEAAKDCVVGGYSIPRGSRVLVIAWAINRDCGAWKDGDTFRPARFIPGEGEAAGLDLKGSCYEFLPFGSGRRSCPAQGLGQHAVEFAVAQLAHGFNWKLPDGMKPAELDMGDIFGLTASRSTRLYAVPTPRLTCPV

SEQ ID NO: 37 - protein, 515 aa, Triticum aestivum
MAAYAKVGTEFLKDPLIWLFLASLAFVILQRRRLGSAPFPPGPKPLPVIGNMALVDQLTHRGLAALAKQYGGLLHLRLGRLHVYAVSTPEYAREVLHVQDAALSNRPATIAVVYLTYGRSDMAFAHNGAYWRQMRKLCVTKIFSRRRAETWLAVREGYGALACAVSRRCGEAVNLGELIFNLTVSVIFRAAFSTRDEDGLDEFIAILQEFSSLLGLFHIGDFFPWLGWVGRRGFNRRLRTARGALDKFIDRIIDEHMKRGKNAADPEADLVDGLLAFLAEANPISGKHREDALRFTRDNAKAMIMDMLFGGPETVGSMTEWAMAEMMRSPDDLRRLQRELANVVGLHRTVDETDLDKLPFLRCVVKEALRMHPPIPLLLHEAAKDCFVGGYSVPKGSRVLVNAWAINRDPGAWKDGDTFRPSRFMPGEGEAAELDLNGGCYEFLPFGSGRRSCPAQGLGQHAVEFAVAQLAHGFNWELPDGMKPAELDMGDIFGLTALRATRLYAVPTPRLTCPM

SEQ ID NO: 38 - protein, 535 aa, Triticum aestivum
MVGLAKIAMDWLQEPLSWLFVASFVFVVLQRHRQRLRGKAPPLPPGPSPLPIVGNMFMMDQLTHRGLAALARQYGGILHLRLGQVHAVVLSTPEYAQEVLQAQDVAFSNRPATVAAIYLTYDRADMAFAHYGPFWRQMRKLCVMKLFSRRRAGTWLAVRDESAALVRAVARRSGESVNLGELIFNLTKNVTFRAAFGADAAGDAGKRDEFIAIMQEFSQLFGGSSIGDFIPWLGWVDQGLNVRARTARAALDEFIDKIIDEHMRRGKNPDDVDADMVDDMLAFLPEAKPKKDAGDDLQNSLHLTRDNIKAMIMDVMFGGTETVASGIEWAMTEMMHSPDDLRRLQQELADVVGLDRNVDESDLDKLPFLKCVIKETLRLHPPIPILHHENAEDCVVGGYSVPRGSSVMINVFAIGRDAKVWKDADTFRPSRFMTGEGEAARVDFKGSCFEFLPFGSGRRSCPGMALGIYSLEFAVAQLAHGFSWALPDGMKPSELDMTDIFGLTAPRATRLCAVPTPRLTYPLISDVDATHKGNT

SEQ ID NO: 39 - protein, 535 aa, Triticum aestivum
MVGLTKIAMEWLQDPLSWLFVASVVFVMLQRRRRRGRAPPLPPGPNPLPIVGNMSMMDQLTHRGLTALAKKYGGFLHLRLGKVHAFAVSTPEYAQEVLQVQDAAFSNRPASLAATYLTYDRADMAFAHHGPFWRQMRKLCVMKLFSRRRPETWLAVRNESAALVRAVARRSGETVNLGELIFNLAKNVTFRAAFGAGAAGDAGKQEEFIAILQEFSKLFVEFCIGDFIPWLSWADPQGINVRLRAARAALDQFIDKIIDEHMKRGRNPDDVDADMVDDMLAFLPEARTKKAAGDRGDDLQNTLRLTRDNIKAMIMDVMFGGTETVASAIEWAMSEMMHCPDDLRRLQQELADTVGLDQNVDESDLDKLPFLKCVIKETLRLHPPIPLLNHENAEDCVVGGYSVPRGSRVMINVFAIGRDASTWKDADAFRPSRFMEGEGEAAGVDFKGGCFEFLPFGSGRRSCPGMALGLYSLELIVAQLAHGFNLALPDGMAPSELDMRDVFGLTVPRATRLCVVPTPRLTCSLVADDDAAHQA

SEQ ID NO: 40 - protein, 526 aa, Triticum aestivum
MVDLSMIDMEWLQEPLSWLFVASVIFVLLQRRRGKAPPLPPGPYSPPIVGNIFMMDQLTHRGFAALAKQYGGLLHLRLGKVHTFAVSTPEYAQQVLQAQDAAFSHRPATIATTYLTYDRADMVFARYGPFWRQMRKLCVMKLFSRRRPGTWLAVRDESAALVRAVARRSGEPVNLGDLIFNLSMNVTFRAAFGAEAAGDGDGRKQHEFIAIMQEFSKLFGAFSIGDFIPWLGWADPQGIKVRLRAARTALDEFIDKIIDEHIKRGRNPDDMDADMVDGMLAFLPEAKPDKAAGDDLHHTLRLNRDNIKAIIMDVMFGGTETVASAIEWAMAEMMHSPNDLLQLQQELADTVGIDRNVDEPDLNKLSFLKCVIKETLRLHPPIPLLHRENAEDCVLGGYSVPQGSSVNINVFAMGRDTKVWKDADTFRPSRFMEGEGEAAGVDFKGGCFQFLPFGSGRRSCPGMALGLYSLELVIAQLAHGFNWALPNGEKPSVLDMSDIFGLTAPRATRLWVVPTPRLTCPLVVDV

SEQ ID NO: 41 - protein, 519 aa, Oryza sativa
MANGVAEYLLMDPWLVLWLVLASMAFALLHLRRRARRGAPPLPPGPRPLPIIGNMLMMDQLTHRGLAAMAARYGGLLHLRLGRVHMVVVSSPEHAREVLQVQDGDFSNRPASIAIAYLTYGRADMAFSHYGHFWRQVRKLSAVRLFSRRRAQSWRAVRDESAKLVGAIARRAGEAVDLGELIFGLTKDVIFRAAFGTRDGGGHGELEVLLQEFSKLFGAFNVGDFIPWLAWLDPHGINRRLRAARAALDSVIDRIIDEHVSNPAGDEDADMVDDMLAFLDEAGRDQTGGGGELQGTLRLTRDNIKAIIMDFVFGGTETVASAIEWAMAELLHSPGDLRRLQAELADVVGLGRGVEEGDLEKLPFLRCVAMETLRLHPPIPLLLHEAAADCVVGGYSVPRGARVVVNVWSVGRDAGAWKGDAGAFRPARFMAGGEAAGMDLRGGCFELLPFGSGRRACPAIVLGMYELELVVARLVHAFGWAPPGGVAPEELDMADGFGLTAPRAARLRAVPTPRLTCPM

SEQ ID NO: 42 - protein, 530 aa, Oryza sativa
MADMVKFTMEWLQDPLSLAIVVTVAVLIMRMQRRRAAPFPPGPKPLPIVGNMAMMDQLTHRGLAALAKEYGGLMHLRLGRLHAFAVSTPEYAREVLQAQDGAFSNRPATTAIAYLTYDRADMAFAHYGPFWRQMRKLCVVKLFSRRRAETWLAVRDESAALVRAVAASRGEAAVNLGELIFNLTKNVIFRAAFGTRDGEGHDEFIAILQEFSKLFGAFNIGDFIPWLSWADTNGINARLVAARTALDRFIDKIIDEHMERGKNPDDADADMVDDMLAFLAEAKPHAGKAAAAAAGAGDGADDLQNTLRLTRDNIKAIIMDVMFGGTETVASAIEWAMAEMMHSPDDLRRVQEELAAVVGLGRDVAESDLDKLPFLRCVIKETLRLHPPIPILLHETAADCLVAGYSVPRGSRVMVNVWAIARDRAAWGPDADAFRPSRFAAGAAAEGLDFRGGCFEFLPFGSGRRSCPGMALGLYALELAVARLAHGFNWSLPDGMKPSELDMSDIFGLTAPRATRLSAVATPRLTCPLY

SEQ ID NO: 43 - protein, 526 aa, Zea mays
MVTVAKIAMEWLQDPLSWVFLGTLALVVLQLRRRGKAPLPPGPKPLPIVGNMAMMDQLTHRGLAALAERYGGLLHLRLGRLHAFAVSTPEYAREVLQAQDGAFSNRPATIAIAYLTYDRADMAFAHYGPFWRQMRKLCVMKLFSRRRAETWVAVRDECAALVRAVASGGGGGGEAVNLGELIFNLTKNVTFRAAFGTRDGEDQEEFIAILQEFSKLFGAFNVVDFLPWLSWMDLQGINRRLRAARSALDRFIDKIIDEHVRRGKNPDDADADMVDDMLAFFAEAKPPKKGPAAAADGDDLHNTLRLTRDNIKAIIMDVMFGGTETVASAIEWAMAEMMHSPDDLRRLQQELADVVGLDRNVNESDLDKLPFLKCVIKETLRLHPPIPLLLHETAGDCVVGGYSVPRGSRVMVNVWAIGRHRASWKDADAFRPSRFTPEGEAAGLDFKGGCFEFLPFGSGRRSCPGTALGLYALELAVAQLAHGFNWSLPDGMKPSELDMGDVFGLTAPRATRLYAVPTPRLNCPLY

SEQ ID NO: 44 - protein, 532 aa, Zea mays
MAAAVANIGMEWLQDPLSWVFLGTVCLVVLQQLRRRRGKAPLPPGPKPLPIVGNMGMMDQLTHRGLAALAETYGGLLHLRLGRLHAFAVSTPEYAREVLQAQDGAFSNRPATAAIAYLTYDRADMAFAHYGPFWRQMRKLCVMKLFSRRRAETWAAVRDECAALVRAVAVGGGSGGEAVNLGELIFSLTKNVTFRAAFGTRDGEGQEEFIAILQEFSKLFGAFNVGDFLPWLGWMDLQGINRRLRAARSALDRFIDKIIDEHVRRGKSPDDADADMVDDMLAFFVEATPGKATGAAAAADGGDDLHNTLRLTRDNIKAIIMDVMFGGTETVASAIEWAMAEMMHSPDDLRRVQQELADVVGLDRNVSESDLDRLPFLRCVIKETLRLHPPIPLLLHETADDCVVAGYSVPRGSRVMVNVWAIGRHRASWKDADAFRPSRFAAPEGEAAGLDFKGGCFEFLPFGSGRRSCPGMALGLYALELAVAQLAHAFNWSLPDGMKPSEMDMGDIFGLTAPRATRLYAVPTPRLNCPLY

SEQ ID NO: 45 - protein, 515 aa, Glycine max
MANLDLDPFQTSILILVPIALLVALLSRTRRRAPYPPGPKGLPIIGNMLMMEQLTHRGLANLAKHYGGIFHLRMGFLHMVAISDPVAARQVLQVQDNIFSNRPATIAISYLTYDRADMAFAHYGPFWRQMRKLCVMKLFSRKRAESWQSVRDEVDAAVRAVASSVGKPVNIGELVFNLTKNIIYRAAFGSSSQEGQDEFIKILQEFSKLFGAFNIADFIPYLGCVDPQGLNSRLARARGALDSFIDKIIDEHVHKMKNDKSSEIVDGETDMVDELLAFYSEEAKLNNESDDLQNSIRLTKDNIKAIIMDVMFGGTETVASAIEWAMAELMRSPEDQKRVQQELADVVGLDRRAEESDFEKLTYLKCALKETLRLHPPIPLLLHETAEDATVGGYFVPRKARVMINAWAIGRDKNSWEEPETFKPARFLKPGVPDFKGSNFEFIPFGSGRRSCPGMVLGLYALELAVAHLLHCFTWELPDGMKPSEMDMGDVFGLTAPRSTRLIAVPTKRVVCPLF

SEQ ID NO: 46 - protein, 515 aa, Glycine max
MANLDLDPFQTSILILVPIALLVALLSRTRRRAPYPPGPKGLPIIGNMLMMEQLTHRGLANLAKHYGGIFHLRMGFLHMVAISDPVAARQVLQVQDNIFSNRPATIAISYLTYDRADMAFAHYGPFWRQMRKLCVMKLFSRKRAESWQSVRDEVDAAVRAVASSVGKPVNIGELVFNLTKNIIYRAAFGSSSQEGQDEFIKILQEFSKLFGAFNIADFIPYLGCVDPQGLNSRLARARGALDSFIDKIIDEHVHKMKNDKSSEIVDGETDMVDELLAFYSEEAKLNNESDDLQNSIRLTKDNIKAIIMDVMFGGTETVASAIEWAMAELMRSPEDQKRVQQELADVVGLDRRAEESDFEKLTYLKCALKETLRLHPPIPLLLHETAEDATVGGYLVPKKARVMINAWAIGRDKNSWEEPESFKPARFLKPGVPDFKGSNFEFIPFGSGRRSCPGMVLGLYALELAVAHLLHCFTWELPDGMKPSEMDMGDVFGLTAPRSTRLIAVPTKRVVCPLF

SEQ ID NO: 47 - protein, 520 aa, Glycine max
MDWQSMMGNLDPFQRTILILVPLTLLLLLLLSRTRPRPPYPPGPKGFPIIGNMFMMDQLTHRGLANLAKHYGGIFHLRMGFLHMVAISDPDAARQVLQVQDNIFSNRPATIAISYLTYDRADMAFAHYGPFWRQMRKLCVMKLFSRKRAESWQSVRDEVDAAVRAVASSVGKPVNIGELVFNLTKNIIYRAAFGSSSQEGQDEFIKILQEFSKLFGAFNIADFIPYLGCVDPQGLNSRLARARGALDSFIDKIIDEHVHKMKNDKSSEIVDGETDMVDELLAFYSEEAKLNNESDDLQNSIRLTKDNIKAIIMDVMFGGTETVASAIEWAMAELMRSPEDQKRVQQELADVVGLDRRAEESDFEKLTYLKCALKETLRLHPPIPLLLHETAEDATVGGYFVPRKARVMINAWAIGRDKNSWEEPETFKPARFLKPGVPDFKGSNFEFIPFGSGRRSCPGMVLGLYALELAVAHLLHCFTWELPDGMKPSEMDMGDVFGLTAPRSTRLIAVPTKRVVCPLF

SEQ ID NO: 48 - protein, 518 aa, Glycine max
MDLLLELKTALEPFRETLLFTIPLTLLLLGIVSRIRRKTAPYPPGPKGLPLIGNMNIMNQLTHKGLANLAKQYGGVLHLRIGFLHMVAISNAEAAREVLQVQDNIFSNRPATIAISYLTYDRADMAFAHYGPFWRQMRKICVMKLFSRKRAESWNTVRDEVDFIIRSVTNNLGSPVNVGELVFNLTKNIIYRAAFGSSSQEGQDEFISILQEFSKLFGAFNVADFVPFLGWVDPQGLNKRLVKARASLDSFIDKIIDEHVQKRRSGHDGDEESDMVDELLNFYSHEAKLNDESDELLNSISLTRDNIKAIIMDVMFGGTETVASGIEWAMAELMRSPDDLRRVQQELADVVGLDRRVEESDLEKLVYLKCAVKETLRLHPPIPLLLHETAEDAAVCGYHVPKGSRVMINAWAIGRDKSAWEDAEAFKPSRFLNPHVPDFKGSNFEFIPFGSGRRSCPGMQLGLYTLELAMAHLLHCFTWELPDGMKPSELDTSDVFGLTAPRASRLVAVPFKRVLCPL

SEQ ID NO: 49 - protein, 521 aa, Glycine max
MDWQSMMGNLDPFQRTILILVPLTLLLLLLLSRTRPRPPYPPGPKGFPIIGNMFMMDQLTHRGLANLAKHYGGIFHLRMGFLHMVAISDPDAARQVLQVQDNIFSNRPATIAISYLTYDRADMAFAHYGPFWRQMRKLCVMKLFSRKRAESWQSVRDEVDSAVRAVANSVGKPVNIGELVFNLTKNIIYRAAFGSSSQEGQDDFIKILQEFSKLFGAFNIADFIPYLGRVDPQGLNSRLARARGALDSFIDKIIDEHVQKKNNYQSSEIGDGETDMVDELLAFYGEEAKLNNESDDNLQNSIRLTKDNIKAIIMDVMFGGTETVASAIEWVMSELMRSPEDQKRVQQELADVVGLDRRVEESDFEKLTYLKCALKETLRLHPPIPLLLHETAEDATVGGYFVPRKARVMINAWAIGRDKNSWEEPETFKPARFLKPGVPDFKGSNFEFIPFGSGRRSCPGMVLGLYALELAVAHLLHCFTWELPDGMKPSEMDMGDVFGLTAPRSTRLIAVPTKRVVCPLF

SEQ ID NO: 50 - protein, 512 aa, Cynara cardunculus var. scolymus
MDVLQLQGLLHPMPILFYVALPLLTFFLLSSFRRKPLPPGPRGWPLIGNMLMMDQLTHRGLASLADKYGGLLHLKMGFSHTVAVSSPEMARQVLQVQDNVFANRPATIAITYLTYDREDMAFANYGPFWRQMRKLCVMKLFSRKRAESWDSVRDEVVSMIKITAASSGSAVNLGELVFGLTHDIIYRAAFGSISHEGKEEFIRILQEYTKLFGAFNLADFIPWLGFIDPAGLNTRLPKARGELDGFIDKIIDEHLRKEKKTGDDADNDMVDEMLAFYSEEGKVNEGEDLQNAIRLTRNNIKAIIMDVMFGGTETVASAIEWALTELMHTPEALKRAQQELADVVGLDRRVEESDFEKLTYFKCIIKETLRLHPPIPVLLHQSSEATEVAGYHIPKGTRVMVNAYAINRDKNAWKDPNTFNPSRFLENGAPDFKGSNYEFLPFGSGRRSCPGMQLGLYAMEMAVAHLLHSFTWQLPDGMKPSEIDMTDVFGLTAPKATRLVAVPTPRLLCPLY

SEQ ID NO: 51 - protein, 506 aa, Cynara cardunculus var. scolymus
MDSIQIPISIYVIIALLTFSFLAWLRRKNLPPGPMGWPVIGNMLMMDQLTHRGLARLAEKYGGILHLKMGFRHTIAVSSPEIARQILQVQDNIFANRPATIAITYLTYDRVDMAFADYGPFWRQMRKLCVMKLFSRKRAESWDSVRDEVDSMVTTTATNSGLPVNLGELVFGLTHDIIYRAAFGSTSHEGKEEFIRILQEYTKLFGAFNLADFIPWLGFIDPAGLNTRLPAARAALDGFIDKIIDQHLAKEKKVGDENVDNDMVDEMLAFYSEEGKTNEAEDLQNAIKLTRDNIKAIIMDVMFGGTETVASAIEWAMTELMHTPEALKLVQQELTNVVGLDRRVEESDFEKLPYFKCVIKETLRLHPPIPVLLHQSSEATEVSGYHIPKGTRVMVNSYAINRDKNAWTDPNTFNPSRFLQNGAPDFRGSNYEFLPFGSGRRSCPGMQLGLYAMEMAVVHLLHCFNWELPDGMKPSEIDMGDVFGLTAPKAIRLVAVPTPRLLCPLY

SEQ ID NO: 52 - protein, 520 aa, Raphanus sativus
MESSISQTLGQVLDPTTGILIVVSIFIFIGLITRRRRPPYPPGPRGWPIIGNMSMMDQLTHRGLANLAKKYGGLCHLRMGFLHMYAVSSPDVAKQVLQVQDSVFSNRPATIAISYLTYDRADMAFAHYGPFWRQMRKVCVMKVFSRKRAESWASVRDEVDKMIRSVSNNVGKSINVGEQIFALTRNITYRAAFGSACEKGQDEFIRILQEFSKLFGAFNVADFIPYFGWIDPQGINKRLVKARNDLDGFIDDIIDEHMKKKENQNTADDGEVVDTDMVDDLLAFYSEEAKLVSEATELQNSIKLTRDNIKAIIMDVMFGGTETVASAIEWALTELLRSPEDLKRVQQELAEVVGLDRHVEESDIEKLTFLKCTLKETLRLHPPIPLLLHETAEDTEIDGYFVPKKSRVMINAFAIGRDKNSWVDPETFRPSRFLEPGVPDFKGSNFEFIPFGSGRRSCPGMQLGLYALELAVAHILHCFTWKLPDGMKPSELDMSDVFGLTAPKATRLYAVPSTRLICAV

SEQ ID NO: 53 - protein, 518 aa, Raphanus sativus
MESSVSQTLSQVFDPTTTILIVVSVFIFIDLITRRRRSYPPGPRGWPIIGNMLMMDQLTHRGLANLAKKYGGLCHLRMGFLHMYAVSSPDVARQVLQVQDSIFSNRPATIAISYLTYDRADMAFAHYGPFWRQMRKVCVMKVFSRKRAESWASVRDEVDKMIRSVSSNVGKSINVGEQIFALTRNITYRAAFGSACEKGQDEFIRILQEFSKLFGAFNVADFIPYFGWIDPQGINKRLVKARNDLDGFIDDIIDEHMKKKENQNTVDDGDVDTDMVDDLLAFYSEEAKLVSETTDLQNSIKLTRDNIKAIIMDVMFGGTETVASAIEWALTELLRSPEDLKRVQQELAEVVGLDRHVEESDIEKLTFLKCTLKETLRLHPPIPLLLHETAEDTEIDGYFVPKKSRVMINAFAIGRDPKSWPDAETFRPSRFLEPGVADFKGSNFEFIPFGSGRRSCPGMQLGLYALELAVAHILHCFTWKLPDGMKPSELDMNDVFGLTAPRATRLFAVPSTRLICAV

SEQ ID NO: 54 - protein, 515 aa, Raphanus sativus
MESLLSQNLNHVIDPIPSALLITISLLVVVYLISQWLKPLYPPGPKGLPVIGNMLMVNQLTHHGLAKLANRYGGLFHLRMGFRHVFAITSPDVARQVLQVQDISFSNRPVTVAINYLTYDLADMAFAPYGPFWRQMRKVCVMKVFSRKRAESWASVREEVNNMVRSLSSNDVGKPVNVGDLIFTLTRNITYRAAFGAACETEQDEFIRILQEFSKLFGAFNIADFIPFLGWLDLQGINKRLVKARNDLDGFIDEVIDEHMKKRETINGDEDTDMVDDLLAFYSEDSSPNRSKNAVKLTRDNIKALVMDVMFGGTETMASGIEWALTELLRNPAELKRLQQELTEVVGLDQRVDDTHLEKLTFLKCTLKETMRLHPPIPLILHEAIEDTKLQGFSVPKGSRLMINAFAIARDPKLWVDPETFRPCRFMEPGMPDFMGTNFEFIPFGAGRRSCPGMQLGLYAMEVAVANIIHCFTWKLPDGMKPSELDMSDVMGLTAPRATRLIAVPDTRLICSVWP

SEQ ID NO: 55 - protein, 509 aa, Raphanus sativus
MDCLLCSPILYVVLIFLWYLVRVLVTRGNPFPPGPKGYPIIGNMKLKNQLNHRGLAELAKQYGGLLHLQMGKIHIVAASTAEMAREILQVQDVVFANRPANVAISYLTYNRADMAFANYGPLWRQMRKVCVMKLFSRKRAESWASVRDEINTMVQTLTKQTGSPVNVGELVFALTRNITYRAAFGSFARDGQDEFVKILQEFSKLFGAFDITEFLPWMKWFSNRDFSKRLENARKSLDGFIDRIIDAHIEKKNSRKQEDDGLEDDMVDELMAFYSGENGGKSNDSLSTFRLTRDNIKALVMDVMFGGTETVASAIEWAMTELMKNPHELVKLQQELADVIGLNRQFHESDLENLPYFRCAMKETLRLHPPIPLLLHEAAADSVVSGYSIPRDSRVMINVYAIGRDGSVWTEPDAFRPGRFMEDKAPDFKGSDFEFLPFGSGRRSCPGMQLGLYAMELAVAHMLHSFDWKLPEGVSSGDLDMTDMFGLTAPRATRLIAVPSYRLKCPMVI

SEQ ID NO: 56 - protein, 517 aa, Raphanus sativus
MYTPMTLILLVPLLLFLYWHLLSRRLRLRKSYPPGPKGLPIIGNILMMNQVNHRGLAKLSRTYGGLLHLRLGLSHLFVVSSPQIARQVLQVQDHVFSNRPTTIAIRYLTYGQSDLAFGNYGPFWRRMRKLYVMMLFSRKRAESWASVDEEVHKAVRFVAANVGKPLNICKVAFSLTRDITFGAAFGSSSSTSDEGRLDEFLEIIQEFSKLFGEFNVADYVPSWLSWIDPQGINKRVERARKSLDCFIESIINDHLDKKKTENNVDVDEETDMVDQLLAFYKEEVKVKDSETKINLNNIKGIIMDVMFGGTETVALAIEWVLTELLRSPENMKRVQEELATVVGLERWSVEDTHLEKLTFLKCVLKETLRLHPPFPLLLHETVEDAEVSGYSIPKGSRVMVNTYALGRNPNSWSDPEIFNPSRFLDPGAPDLKGNSFEFIPFGSGRRSCPGMQLGLYAFELAVAHLLHCFTWKLPNGVKPGDVDTIEGPGLTVPKANSLVAVPTTRLLSPIVLESHNV

SEQ ID NO: 57 - protein, 505 aa, Allium cepa
MMDMQSILIFTLPFVTLLFLVITSRRRPKLPLPPGPRPLPIIGNLNLIDKLTHRGLAHLANQYGGIFHLKLGSVHTFSISTPEIAKEVLQTQDLAFSNRPATIAITYLTYDRADMAFTHYGPFWRQIRKLCVMKLFSRKRAESWASVREEIEKAVSTAAAGAGTVVNVGELVFNLTKNITFRAAFGAKSGEEQDEFLGILQEISKLFGAFNVGDFVPGLRYLDPQGIGRRMRKVRKELDGFIDRIIDEHVQNRKEVDDVEADMVDEMLAFVGQGKSIGRDSDELRLTRNNIKAIIMDVMFGGTETVASAIEWAMAELLKSPEDLKRLQQELTSVVGLDRKVQDSDLDKLPYLKCVIKETLRLHPPIPLLLHETAEDCEIQGYSIPKKSRVMINVWAIGRDKSAWKDADQFKPSRFVKGGEYEQVDFKGNFFELLPFGAGRRSCPGMQLGLYALDLTVANMAHCFDWELPDGMKPGEMDMSDVFGLTAPRAVRLAAVPSPRLTCRI

SEQ ID NO: 58 - DNA, 5782 bp, Lactuca sativa
  source 1..5782: /organism="Lactuca sativa" /mol_type="unassigned DNA"
gaaatatatttcatttttagcacatatttaccacataaacacaagaaatcacacataacatacaaatgcacatagatcttcacaattttacttgtattctcccccataaatcatatgaaaaccgaaaatagaggggtataaactcaccttgagtttgtggattcagtttttgaagaagatgtggaaagatgaaatgatttttcggccctagcaactcccttgagtagatctcgaactcaagaagatttcacaagtatgtatcttggagtgattcttggatgaaaaccttcttgaatgcccttaatcttgaaaattttgtaggaggaatgaaggtgttcttgagaggatttggaagtgaattaagtgtgtgtgtgtgtgtgtttggtgatcctcggtcaagagtagaagaagagatgggagggagtgacgtgagttgacatgcatagagatatgagaatggtgcatggatatcctatgtacatttatgaggtggcaccacaaacctcatttcatcttttcttttatttatttttattttttttttgttttacttgggccgaaatgggctaaggaaggatgaaggaatcactttggcccattctttccttggctcgagttcatgaggcccataaggaaaacttacggcccgttgggcccttagggtagctcacgacccaaatctttatataagagaatggatttgagtccatcaaagctaattggatttgttatggcccaataaggcctattaaagataaactagtccattttaggcttataaggcccaaaaaggttaagtctcatgagagtgggtccaatgagagcccatttaagagttctaagcccaaaatagtcaaattgaaagcttattggcccattaggcccaataaggaaattctagttcatatatgacttaaaccggaatttctagggtttttcaactttacttgatgaatctaggtttgaatgtgtttccataggttgaacatcaagcataacatgaattagggttacgagtttacaatagataatgttccaagagtacagaatttcctagctagaatgctatttgtgacatctgtgcctaatagatactttgatttttaattatacttaactcaagtaagttgaataaatatttttgttaattataatttattgtattaacttgaagcatttgaataatagaaaatatttttggtttctatacataaatgtaagtcatatcgaataacaaacttgaggtaggaagataaaaaataaatcgaaatttgcatgaggagaacaaaaccaaaacagaataattaaatattattaaaaaaaacatgtgagtggttggtaaagtaaccaatggttaaactcaaatactctctattttaatctaataataagtaataacaatgtaaatattttacatcttaacaagtggtacataaaagagaattatttctgacatgtcagattaatttccaaaattacttgtctttgttcatttattatatttaaaaaagaatatacttgacgcaattagtgtaacaagttatccaaaaatccattaccaccaaaatcaaaacaaatctaaacatatttactcttacaatctaaacataatcattaaaaaaactaaattaaataaacaataacctaaacaaataatttatctcatatgattacaagaatgtaaaattaattggtcgaccaagtcacttgtgcagtagccagcaactagcaacgttatgctgacatacaattctatcagatctaagccgaataaaaaatcaaactatatttatgtgtaaataattgaccggcactctacgtctttgtctcaagacaaaagaattagtcaaacatttcctgtaattctcatttttaatatttataataaataaaataaaagaaaaaaaaaatagtaatatccatacgacttcccacctttcaaacagggtgtgcccgtttatcttgtatataaacacccctttatctcactctttaggtagcaacattcatccagttgccacttaaaacctccatttgaatcaaaatggaatcacttcaaatccccatagcattctacgctataatagctatcttaactttcttctttctttcatgggtccgccggaaaccactcccgccggggccaatggggtggccaatcatcggcaacatgttgatgatggaccaacttacccaccgtggcttagcccgtttggcagaaaaatacggtggtatccttcatctaaagatgggtttcagccacaccattgcagtgtcctcgccggagatggcgaggataatacttcaagaaaaagataacatctttgccaaccgtccggcaaccatcgccatcacttacctgacttacaacggcgtagatttggcttttgctaattatggacctttctggcgacaaatgcgaaagctttgtgtcatgaagctgttcagccggaaacgagcggagtcatgggactccgtcagggatgaggtggacaccatggtgaaagccaccgccattaactccggtacgccggtaaacttgggtgagcttgtttttgggttgacccatgatattatctaccgagcagcttttgggtcgatttcacatgaagggaaagaagagtttatcagaatccttcaagaatacaccaaactttttggcgcattcaatttggctgactttatcccgttcctcgggtttattgatccggcggggttgaacacacgtttaccggcggccagggcggcgttggacggattcattgacaaaatcatcgacgagcatttgcgtaaaggaaagaaaaccggcgatgaaggtttggataacgatatggttgatgagatgttggcgttttacagcgaggaaggaaaagtcaacgaaggtggtgatttgcaaaacgccattaaccttactcgagataacatcaaagccataatcatggtaagtaatgaaaccatgaatacattctttttataaatcattataacattccaaattctaaaagttaatccaaaacttttgtaggatgtaatgttcggtggaactgagacagtggcgtccgccatagaatgggccatgacggagctaatgcatacaccggaggcactaaagcgcgtgcaacaggagatggcaaatgtcgtcggacttgaccggcgcgtggaggagtctgacttggagaagctgacgtacttcaaatgcgtcatcaaggaaaccctccgactacaccctccgatcccagttctcctccaccagtcttcggaggcgacagaagtttccggctaccatatacctaaaggaacacgtgtcatggtgaacgcgtatgctattaatcgtgataagaactcttgggaagatccggatacgtttaacccgtcacgttttttacaaaacggagctccggattttagaggaagcaactatgagtttctgccatttggttctggtcggaggtcgtgtccggggatgcaactagggttgtatgcgatggagatggcggtggcccaccttttgcattgtttcacgtgggaattgccggatggaatgaagccaagtgaaatcgacatgggtgatgtgtttggactcacagcaccaaaagcaataagattggtagcagtgccaactccgcgtttattatgcccattgtattgaaatggttttatcatttatatgtatttatatgtaggttgcatacggtttcaaattgtataagattaagatatataataacacggaaatatttttcatatcatatatatggtatcaccataagccttatttgaactcaatgggattgtatcgatctttatttttaaaattcataggcttaaggccggtccaagaaaacttgaagcccggggcaaaacacaaaaatgggattgtagggattatatggatctttattgtatggatctttatttttaaaattcataaagatatgtgaaaactcagaaacgaactatatataaaaagatatttgcacctttaatattcggtagtaaaaaaatgtctctatttgtatgttgtttcatccaacacacctttattacaaagatatacatcaccaaaacttacccttcaacttaaggttcatagctaaactatacttctgaacttaagtttctatcaaaaacaaagaaataaaaaactaaaaatgattgatttttccaaaagataacatgatacacagtgtagtagatcattgcacattgcataaattgccaacaaatactaacgtctacttctatcacatttttcttttttcacttatagtgctttaaaaacctctttcgctatcatctataacaacatcatcattaattcattaacatgcatacctataatcataattaaaaatacaaaaaacttgcctaaaatgaaaatgcatcgggttcttgttctaggtttgcacttaaattcagccaaaaatgtagtatgatctgaataccattcacaatcagagaaggtcggatactctaggggtgagcaaaaccgaacccggaaaccgaaaaaccgacaaaaaccggcaaaaccgaaaccgaaaaaccgaaaccgaagcataaaccgacggtttgggtttatattttttgaaaaccgaaaatttcggtttgggttgggtttttgggtttggtaaaaccgatagaaaccgaaccgaaccgattatatatactatttgtaaaaatatataatttatatacaaatataaatatgtttatagaagtaatgtcaaaaggatgcgctggttgaggtgggtaacgctcttgcttgtgtttctgaaggtttcaagttcgaaacctgtggccaaaattttacttcttttattttcgcagctatataaacctatcccacatcgacacatgatcgaaactttgctacatatgctcgcctacataagctaaacatacatcctcttcaggtttattcagctattagctttgtcccacatcgcttgagggatcaaagtagaagccattttcacttctataaaaatgaggatacgaaatgatagaaaaacagttttaggtttggtttagttcaaaaaccgaaaccgaaaacccgatttggaaaccgataatccataaaaccgaacccatgggtttagggtcggttagggttcaaatttttagaaaccgatggtcatcggtttgggttcggttttagggcaaaaccgacccaaaccgacccatgctcagccctaggatactcctttgattctatacaacacaaaattccgaagctaaaaaaaagattcataaaaaaaaaatcgtatttcaaacaagaataaaaaatttcaagaaggctatgataaactagaacttataaagacatataatcagtttcgtctcaatgtcaagtataatcgattttgtctcaatttaaagaagattttgagtctgagtttgtaacactcgtgtttctagcctagacatttatatcgaggtgatagtctaggttaacctttgtaactcattttgaagaaataaaaagaaattatgtgaatattatgtgaattatgtgttttatgcttaattattagggcttaattaattaagaataaaaataagcgtcaaaattaaagtgtgagataagcccgatatctttacataaagttgtagtggtccaaacaaggatttcagggatataaagaatatcaaaatccgagttataaagaagaagttatgacctgtcgaagtttcgcgacaaaaccggcacggtgctgaatgtcgtaaaaagtgagtttttgataaactactttttagccttagtaatctaaacgaaagtcat

SEQ ID NO: 59 - DNA, 6306 bp, Lactuca sativa
  source 1..6306: /organism="Lactuca sativa" /mol_type="unassigned DNA"
  misc_feature 501..1883: /note="n = a or t or c or g"
ttttattttgtttaatttaattaatttttatttagataaaataaatgacgaaaataatattttaaaaaaattcaaaattttcatttatttttcattttaaaatatattttttttatccctaaaaggaatgacaacgattgcgttctcatgtcttacaaaatataataatatcacatgactgtaactatatatatatagttttaggttatctggataacaaaaaaccctaaagaaaaatcctaaaaatcataaaaatgtatgaaaaaaaaaatatttaaagatcacaaatattttttttgactttatatttttaaaagtggtaactttttatacaattttgctgaatttttttttgaaaaaaaaaaacctatgatttttaagaatataaagtcaaaaaaagatttgtgatctctaagtattttttatacattattatgattttaaattttttttcgttatccatataaccttctatatatctatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatgtgtgtgtgtgtgtgaaaatagtcaactttccaggattaaatataaaatgatataaataaatgcaaactcattcaaacagaggtgccgctgcatctcatttcaaccactgcccaccctgtatatatacacatcacttgatcttcctttacctagcagcgttttctagttgcacttcattacgctcatactccaatagacttactgaaccgaaactctttgccggaaaatatggatcctaagtccatcttactttacgttgtactccctctcttaaccttcttccttctctcccgattacgccgaaaacctcttccgcctggtccaagagggtggccgctgatcggtaacatgttaatgatggaccaactcacccaccgtggccttgctcgtttgggagaaaaatacggtggtcttcttcatctgaagatgggtttcagccataccgtcgctgtctcgtcccccgaaatagccaggcaagtactccaagttcaagacaacatcttcgccaaccgcccggccaccatcgccattagttacctcacctacgaccggcaagacatggcgttcgccaactacggtcccttttggcgtcagatgcgtaagctttgcgtcatgaagctgttcagcagaaagcgagctgagtcttgggactccgtcagagacgaagttgtctccatggtcaaaatcaccgctgcaagctccggcaccgctgttaaccttggagagcttgttttcgggttaacccatgatatcatttaccgagcagctttcgggtctatctctcatgaaggaaaagaagaattcatcagaattctacaagaatacacaaagctttttggtgctttcaatttggcagattttgtcccgtggcttggatttatcgaccctgccggactgaatacccgtttaccgaaggccagggcggcgcttgacagattcattgataaaatcatcgacgagcaccttgcaaaagagaggaaaacgggcgatgaggaagataatgatatggtggatgagatgttggctttttacagtgaagaaggaaaggtaaacgaaggcgaggatttgcagaacgcgattagactcacccgaaacaatatcaaagccattattatggtaagtaattgttgtttacattaatatataaaaaacaaaacaaaacaagttttctgaaaatagttgttttcgtagtcattttgttgaatactaacaaagtcgtaaatactttagctacttctatacgatacataaaacaattttctgttgtttttgggttttttaatattctatccaataaaaaagtataaaacatatctatttgatgtcatgttcaataaaaaaaatgtattaggtagaatccaaaaagttgtcaatattaattaagtattcgagttgatcacactgggatatggatagaaattgactaattgattacacatgattaattccagtccaacacaccaatacaattatgttcttatcattggttcacaactatagttctttgtttcatgtatttcttgaactatattattacaatgaatttattatgtattgattatatcattgtttatatgtaggatgtaatgtttggtgggactgaaactgttgcttctgctatcgaatgggctttaactgagctaatgcacaccccagaatccttaaaacgtgcacaacaagagctcgctgatgttgttggccttgatcgtcgtgtagaagaatcagatttcgagaagctaacttacttcaaatgtgtcatcaaagaaaccttacgtctccaccctccgatccctgtccttttgcaccaatcatcagaagccacgtcggttgctggctaccacatacctaaagggacacgtgtcatggttaacgcattcgccattaatcgtgataagaactcatggaaggatccacacacgttcaacccatcacgtttcttgcaagatggggcacccgactttaaaggaagcaattatgagtttcttccatttggatctggacgtagatcatgtcctggaatgcaacttggattgtacgcaatggagatggcagtggctcaccttcttcattcattcacatggcagttgcctgatggaatgaaaccaagtgagattgacatgaatgatgtgtttggactcactgcaccaaaagcgattcgacttgttgctgtgccaactcctcggttgttgtgtccgctgtattgagaaacggcgaaaagtttgatattgtgaaaatttgtttatgttgcatcatgcatcaaatcagattgcttttcttttacatctttctagtcatcttccataaagaaagatatacacaaattgaataatgcgtaaagattatattttcatgtacattttgaaatgttcaaactccttgtgtttcttgtgttcatattatattttcttcctcagagaattacacgcatgctttgtgttcatatttgggaaaaaaaaaacatataagttttgctatcaatgtcattcctggtaaaaatgaatgttgttctttatgatgtagcctaaatgtcaacttttttaggtttttctccaactacaactgatatgatatgctgcctgacgagtgactgggcttcttccaagtgggaccttcccattcacaaatttttattatgtttattgtcacaataatgatacttttagtaatataaatattacaaataaataaacaaacaaatatacattctctctctatcattagcatatagataaaaccgcaattacatgcataaaaaaaatataaaccgcattatatgaacaccgaattcgacccgtcagctagagccaacgtgcgaatcatggaaatcaataatattttgggcatgttacgctttgaacatttcacatctcaaccaatatgttcctatcattattattttgggcatgataatgacttaggagggtaactacctcttatctgtgttcacatattggcaacttcttcttttttgtacataagaaagaaactaacttgttttaactgtgtaacatccaaaaaatcatgaccaaaaattttgtttttaatttaatactaaaaccataattgtcaaaccattaatttaatactccagcatcgggcctcgcccgacatcaggccccgcctggcatcgagccccgctcggtatacaaatttgtctctcttaggccccgcctgtctccgggccccgcccgctaaacacatacaatcatctaacatgctaacacataaatcaacatactctactgtatccctgtcctaagaaacatactttgctaataatgagatacaaaatttcgtccgtacccaactagttccagccagggcttcggcagtgcaaggtgagtctcctcactctgtgaatgggtctaaggccacaatgccagcccatgtagtctatgagtaggaagactcgggggggttagccctaggcattgtttgctagtatcttattctagaccaaggactgatgtcgagcgagtgcctgaggaatgttttcatgttagattatacttgttgtatgtgtgatacttgtatgtgcctggtaaagaggtgagtgtgggcgagctcccgtatctcatcactaactgagtacgaacgatgttctgtatctcattattaccagagtatgtttcttaggacagggatacagtaaagtatgtttctttatgtgttagcatgttataggattgtatgtgtttagcgggcgggccccggagacaggcggggcctaagagagacatatatgtataccgagcggggctcgatgcccggcggggcccgatgacggacgggggcnattaaattaatggtttgacaattatggttttagtattaaattaaaaaagaaattttttggtcatgatttttgggatgttacaaagttaaaacaagttagttgctttcttatatacaaaaaataagaagttgtcaatatgtgaacacggataagaggtagttacactcctaatttattttccctttgagttaccggttaaaacagatattagccggtaatattggtgtaatttaaacagttaaaacaagttagttgctttattatgtacaaaaaagaagaagttgctaatacgtgaacatggataagaggtagttaccctcctaagtcattttcctaacatttcacatctcaactaataggttcctatcatattacattataatattatatacaaacgtgtatatgtgttagtacatggataatgacttaggagggtaataacgttttgtggttgtccattttaggtccctaacgtattttttgtgtgtattacaccattaaggttattataaccgtttacaaatagtccttttaacaggaagaaatcggtaaaaaggattatttctatacggttataacaaccttaatggtgtaatacacacaaaaaatacgttagtgac

SEQ ID NO: 60 - DNA, 5618 bp, Cichorium endivia
  source 1..5618: /organism="Cichorium endivia" /mol_type="unassigned DNA"
caatacgtccaactattggcttcatatctaatggatacatttattctcttttttttcgtgatttgaggagtgctttcctcgttgctttctttttaatcatgcttccttcatcatcaaatgtaacattattcctactctcgccgtaaatttcttcacttaatccaatttccaaatgtgattggtgaggcttgaaagtttccccacagacaactattggtacatcatcacatttcccgacgttctgcatcatcaaaatgaataaacttttcatattagaaaccacaaccattattatttaataacataacgcacattaaaagtctgtcttcaacgctgttactcttggttaccacaacatcgttaattgtattcccgtcgtcctacataatcattaagtcatcaacatgttaaacttttcatattagcaaaccacaaccactatatcacattgcgtaccttgtcaggatgctcattagaactttgacttttggtaaccagataatccatggagaaactgtcctgcattagaaacaaaatcgaatataaagaaatatttttattcatgtgacaacttcaatataaaaattagacaccttgattacctcaatatcatcgacagctatcttgcatacatcctcatcggaccttcgcttacacagtagaccccccatgtataccgtatcctccaactacgtaaactcataaaacaacatctgttatatctatgtataagcaggaacatcaacccagacaaaatgaaaaccgtttagttccatgaaaatcgtcaacctcccatacgtgggtaactgaagccacgacctgaagattccccacaaaaagcaaaccctccaaataaccgtcacttctaaatgtatatggtgatttaacaccacttctaaacgtatatggtgatttaacacggttgagattgaaaattgggaagatcgaacggccagaattattggagaaaaaataggactcgttaggaacattaaagacataatttgacaatccctccgtaattttataactttctaacgttttgttagcattataaattaagacgttcaaacaaaaaaaaggcactttaaagtaaagtatttctaccgcatgatattattttccaacatcacctttctttctttgtcgaatattatattaaacaaaacaatgtttatgatataatcattctctgttctataaaaatagttagtcttctatatacttgatgtgattagtgtagtaatttatacgaagaactattttaacctgtatgaaacaaaaacaattatggtttttgatggtggactaattaacataatatttaaatatagaaagttaataagcaacaaccttaactaagaaattatgtcaattgaatacatgaacagaaaattaattcgaagaccaattcacttggtgtagcaactagtaactagtaacattatgctgacatttaatcttattatataaaataaaaaaataaaactctttatatgataatttagaccggcactcgtttgcaagacataagaattagtcaacatttcatgcatgtgattctcacttataataacacaaagtaaaaaggagtaaattgcaaaactggtccttaaattttacttaggattaaaaattcagttaaaaattttaaattatcacgatgtcgtccataaatttgaattttgttgatatgctctttgggattttctcaacagtacacgtttattcttgattttaaagtcatattatatgtattcggaaccatatttgcgacaaaatacaaacttaaagaatgatattattataaataatttgtaaaattgcaatatttggtaaagcacatggacatgatttgtaatttatatagtaatatctatttgaattccggccattcaaacggggtgtgcccgcttaacgtgtatataaacacccctttatttcactctttaggtagcaacattcaaccagttgccacttaactctccatttgaatcaatatggattatcttcaaatccctataccaatctacgctataatcgccatcttaaccttcttctttctggcatggctccgccgtaagccactcccgccaggcccaatggggtggccaatcatcggcaacatgttgatgatggaccaacttacccaccgtggtttagctagtttggcgaacaaatatggtggcatcctccatttaaaaatgggtttcagccacaccattgccgtgtcatcgccggagatagctcggcaaatacttcaagaaaaagataacatctttgccaaccgtccggccaccatcgccatcacgtatcttacctacaaccgcgtagatatggcgtttgcaaactacggaccattctggcggcagatgcggaagctttgtgtcatgaagctgttcagccgtaaacgagcggagtcatgggactccgtcagggatgaggtggataccatggtgaaggccaccgccactaactccgggttgccggtaaacttgggtgaactcgtatttgggttgacccatgatatcatttacagggcggccttcgggtcgatttcccacgaaggtaaagaagaattcatcagaatcctgcaagaatacaccaaactctttggcgcattcaacttggccgactttattccaatgctcgggttcattgacccggcagggttgaatacacgtttaccggcggccagggcggcgttggacggattcatcgacaaaatcatcgacgagcatttgagtaaagaaaagaaaaccggcgaygaaaatgtrgataacgacatggttgacgagatgttggcgttttacagcgaagacggaagaatcaacgaaggcggtgatttgcaaaacgctattaacttgacacgagataacatcaaagccataatcatggtacgtaacttatgtaactcgaataaactaataactatagatctttctaatatttaaaactattgttctaaagaaaaactatacgtaaattttgcaggatgtaatgtttggtggcactgagacggtggcttccgccatagaatggaccatgacggagctaatgcatacaccggaagcactaargcgcgttcaacaagagttgactaacgttgtcggtcttgaccgccgtgtcgaagagtctgacttygagaagctaacctacttcaaatgtgtcatcaaagaaaccctccggatgcaccctccgatcccagttctcctccaccaatcatcggaggcgacagaagtttccggctaccacatccctaaagggacacgtgtgatggtcaacgcrtatgccatcaatcgtgacaaaarctcttgggaagatcccgatactttcaacccatcccgttttttacaaaacggagctcctgattttaggggaagcaactatgaatttcttccgtttggttctggtcggaggtcgtgtccgggaatgcaacttgggttrtatgcgatggagatggcggtggcccaccttcttcattgtttcacgtgggacctgcccgacggaatgaaaccaagtgaaatcgacatgggtgatgtgttcggactcaccgcaccaaaagcaataaggctagtggctgtgccaactccgcgtttattatgtccattgtattgaaataattgtatgtaagttttttagagtttcattttataccagatatatataataacatggaaatatttttcttattgatctttgctaatatattactaaatcaacaaacctagttggaacttgaagtgtttactggatctttatttcccagattgtgacgacttgtaaaagtccgtgtaatccatgtgtgaaacatttggcgatgaaaaactcattggtgaatataaattagtagaaaaaagtcttttcatgacacacaattttgtcataaatggccacaaatgtctgtaattgaaaacacagtcctaaatgaaagacgacagacttttttatcataaatttacgatatacattatgatagataattacgacgtacaatgactgttgtaaacgactaaagatgacaaagtctatcattgaaaactccgtcgaaaatctaagatgacagacattttccgtaaaaatacgacatacatttttgacaaacaattacgacagacattcaaggcatacatctatcacatatattaatgactgaccttttgtatgtcgtaatttgacaaacttttttgacatacattttagtatttcataattttacgttttttaagaatatatttttttctctaaaatgtaccaatattaatcaaaataaacacacatttaatatatgataatacaaattaagataaatatacaaaaagtcaatccatcgcacaaattctagtatgtcaaatacaaagtaccatatgtttatcaaaaagtaattgtcaaatacacaatatcatcggcggtaaataaaggttgtgacataagtagccaaatcttcacgcacctcatcaagctcaacgttcgtatattcattcttcccccaaaaatgaaacaaaagttaatatattagccataaaaaacaattttaaacaattacttgaaaattgatctattttaaacaattttacttgcgttgttatccaacactttgactccttcatcgacaactgctttcatgaatttaagacataataccggcattttgtgccacctggctgcatcggacactatataaatacataataaatggttagtcaaaaaatatattagacaaatcatgaagttaaagctgtagtttgtgctcaccaagacatttatccacctcacactaatccttttgttggaatcacattgtgttgcatataaagataatgctctacaataaattggatgaaatatataacaacaaaaataaaataatgtgtgataatttatattacttatgctttaatcatttgcttcaattttgtattaacatttgcagtccttatagaatcaaggtaatagcaggtggttttttgcatgcttagtacgactagaacccaatagccactgcagaccaaaaagccaaataaaaattaaggcaaatacctctaatgattaagtcaactgagatagtattactaaaagaagacatgtccaaattaaacatgtcttcataaattaagacgtttttttacttaacccattaagtcattccatccacaccaggtaaactagaaacatacaagtataattgtttggatctagttactaaaatagtttagtactttttgtattcatagtcaaatagaaaatctaccccgggattctaaggtaataagatgatgtggtagtcctttcttgtgaacaaccgagatgttatgtttctactctcttgatcgccttttatgaagttttccagtcgtccatctttagatattgcactcgatatcacgaaacagattccatgagctgtttttcctccattcttgatttcttcatataagtgcctgttaagatacaaaagctaaattcgttaaatacacaaaatatagtaaattagtcaaaattaagcacttacaccatataactagatattatagaactggtcaacttatgcattgtaaacaccacttcaaaaccatcccaaaatatatatttgcaacaatcagactcaacaaacagtc

SEQ ID NO: 61 - DNA, 1521 bp, Cichorium endivia
  source 1..1521: /organism="Cichorium endivia" /mol_type="unassigned DNA"
atggattctcttcaaatccctataccagtctacgctataatcgctatcttaaccttcttctttctggcatggctccgccgtaaaccactcccgccaggcccaattgggtggccaatcatcggcaacatgttgatgatggaccaacttacccaccgtggtttagctagtttggcgaaaaaatatggtggcatcctccatctaaagatgggtttcagccacaccattgccgtatcatcaccggagatagctcggcaaatacttcaagaaaaagataacatctttgccaaccggccggccacgatcgccataacctacctcacctacaaccgcgtagacatggcgtttgccaactacggacctttctggcggcagatgcggaagctttgtgtcatgaagctgttcagccgtaaacgagcggagtcatgggactccgtcagggatgaggtggataccatggtgaaggccaccgccattaactccggtttgccagtaaacttgggtgagctcgtatttgggttgacccatgatattatttatcgggctgctttcgggtcgatttcccatgaaggtaaagaagaatttatcagaatcctgcaagaatacaccaaactttttggcgcattcaacttggctgactttatcccaatgctcggttttattgacccggctgggttgaatacacgtttaccggcggccagggcggcgttggatgggttcatcgacaaaatcatcgacgagcatttgagtaaagaaaagaaaaccggcgacgaaaatgtggataacgacatggttgacgagatgttggcgttttacagcgaggacggaagagtcaacgaaggtggagacttgcagaacgccattaacctgactcgagataacatcaaagccataatcatggatgtgatgttcggtggcactgagacggtggcttccgccatagaatggaccatgacggagctaatgcatacaccggaagcactaaagcgcgttcaacaagagttgactaacgttgtcggtcttgaccgccgtgtcgaagagtctgactttgagaagctaacctacttcaagtgcgtcatcaaagaaaccctccggatgcaccctccgatcccagttctcctccaccaatcatcggaggcgacagaagtttccggctaccacatccctaaagggacacgtgtgatggtcaacgcatatgccatcaatcgtgacaaaaactcttgggaagatcccgatactttcaacccatcccgttttttacaaaacggagctcctgattttaggggaagcaactatgaatttcttccgtttggttctggtcggaggtcgtgtccgggaatgcaacttgggttgtatgcgatggagatggcggtggcccaccttttgctttgtttcacgtgggaactacccgacggaatgaaaccgagtgaaatcgacatgggtgatgtgttcggactcaccgcaccaaaagcaataaggctagtggcagtgccaactccgcgtttattatgtccattgtattga

SEQ ID NO: 62 - DNA, 5830 bp, Cichorium endivia
  source 1..5830: /organism="Cichorium endivia" /mol_type="unassigned DNA"
ttccttaaaaggatgtatggaatatgaaattccaattcaggaactttgttttaaaaataaagtgcatcagacctgacctaacatgacttggtattcgtaataatagacatcaagaatcagaaaacatattttctgaaagtacattgctatcgaaagcaccatttcataaaaaaattaaaagaacttgcagactcagacctgacttggaaagaataatcataaaaaaaatacaaaaatgaaataaaatctctcaaaatacattgctattagaattaccattttagagtgatctttttccaaaaagaattgcatcccactcaggtaaaactggattgaacctacttctacagatgactataaaattgatgtaattttttgtctgacttttgtcacatattatgaaaatgataggatggagttctgcttggcctaaaatttttcagttgttgaatttgaatgttatttagctaccgtattcaagcattaataaagtgaatttgattctttacaatacctttttgactcctgtatacattggtcccaaaatagctcctctcttttaaaaaacaatgacaaaactatgaatcaattaccagaaagaggaaatggggttgaaattgttcattcatgaaaccaagttaagtcatacgcctccataatctagataagtaagtaactgaaaccacagtagtcaccaatggaattcaaacaagaaacaatattataaaaacaaattaaaaaagaatgaatgaaaaagaagatgacagtaaagtgtcgttgctacaagaacttaccaattgaaccagaaccatcagtccgctaccaccttaccaaggtatcccttgaaagggttgaatcaaactcggacttgattcatggatttgctaatttatatacactgaagccaaattagataatttactccatatatttggttgttcaacttcaactgtgcataaaaatgtcgaaaccaaatcaaataaaaaccctaaatggtgggatatttaggggatacgaatgatattggtggaaaaagaaaatgtgaatgaaacctgaatccattcatcgatcattcaaaatgaaaccccgattcaagcattgagagtaaaacctcaagaataccatatagtaagatgaagacgtagttgcaccggatggtttaacgatggaagcaacaacagggatgaaaaaaataggctaaaccggaaggcgtagatggaggctgcgaattatagatgttgattgctgttttgtggatgccgtttgagatttgtgcgttcaatatctaattgaatgcattctgtatctaatggctgatttatcgcctaacattcctgatttattggagatttggatggaactagttaattgtgatttaatatgataatagtacaatagaggttttgagcgggaaattaaaaaattggctacacaagaggaggacatgtggcactttttttactcttttattagaagcaaagatatatatactagttatatatatacatgagcagaaattaaaaatatacagcagtaatagcacagaaattattttcctgtatgatagaggcattgtgagattggattattggaataagctaaattttttttttccagatgtgtggtatattgttattttcgttgtagcaccggtaaaataaaaagaatttataaattttaccaattttcgaagaaaattccagtcacgagggcgccatgtgccctatagcaattcagcccctagttatctatgtaaaagcggaaatacgaaaatagtcaaccttacggcttcaagtatatataattatataataaaatgctaactcgttcaaacagagctatgcgctgcatcccctttcaagttcaactactgcgcaccctgtgtttttatatatatacactcgtgtgctctttctatacttggcaaccttctctcagttgcacttcattacccatatactttaagatactcactgaacataaattctttcccggatactatggatcccatgtccatcttactttacgttgtactccctctctttaccttcttccttctctcccgttttcgccggaaacctcttccgccaggtccaagaggatggccagtgatcgggaatatgttaatgatggaccaactcacccaccgtggcctagctcgtttaggtgaaaaatacggtggtcttcttcacctcaaaatgggtttcagccacacggttgctgtctcgtcgccggaaatagccaggcaagtgctccaagtgcaagacaacatctttgccaaccgtccggcaaccatagccatcagttatctgacctacgaccgccaagacatggcgttcgccaactacggtcccttctggcgtcagatgcgtaagctctgcgtcatgaagctgttcagccgaaaacgagcggagtcatgggactccgtcagagacgaagttgtctccatgatcaaaatcaccgctgcaagctccggttccgctgtcaacctcggcgagctggtgtttgggttaacccatgacatcatttaccgggcagctttcggttctatatcccatgaaggaaaagaagaattcataagaattctacaagaatacacaaagctttttggtgccttcaacttagccgattttatcccatggctaggatttatcgaccccgctggactgaacaaccgattacccaaggcccgagcagcgttagatgggttcatcgataaaatcattgatgagcacctaaggaaggagaagaaaaccggcgacgaagaagataatgatatggtggatgagatgttggcgttttacagtgaagaaggaaaagtgaacgaaggcgaggatttgcaaaacgcaattagactcacccgaaataatatcaaagccattatcatggtaagtaatttgttgattaatataatatatttaaaaacaaaacaagataaattttcagaaaaccatagatcttctatatgatttctagaaaaggcataaaataattttatgttggtttaggtaattatccgcttccattttagtcgttattcaattcaatgagtatgaaagcatgatattcgatatgattttcaataaaagaattgtgttaggtgaagtggcaaaatatgacaatactgatcaaatcacactgggatatggatagtttaatactttaattaatttgactaattgattgagttacatatgattacttattcaacacactaatacattatgtttttttattattagttcaggaaaacatgaatctttgtttaatatatctttaactattaatctagtattggtataaacttatgattaaatcattatctatatctatatctataggatgtgatgtttggtggcactgaaactgttgcttctgctatcgaatgggctttgacggagctcatgcataccccagaatccctcaagcgtgcacaacaagaacttgttgatgttgttggccttgatcgtcgtgtagaagagtccgattttgagaagctaacctacttcagatgtgtcatcaaagaaactctccgtctccaccctccgatccctgtcctattgcaccaatcatctgaagccacggaagttgctggctaccacatacctaaagggacacgtgtcatggttaatgcattcgccattaatcgtgacaagaactcttggaaggatccacacacgttcaacccatcacgattcttacaagatggggcccccgactttaaaggaagcaactatgagttccttccttttggatctggacgtagatcatgtcctggaatgcaacttggattgtatgcaatggagatggcggtggctcaccttcttcattctttcacgtggcagttgcccgatggaatgaaaccaagcgagatcgacatgagtgatgtgtttggactcactgcaccaaaagcgatccgacttgttgctgtgccaactcctcgtctgttgtgcccgctgtattgatcagaaagggccggtttgtgattgtgagaatttgttaatgttgcattgaaacaaattgtttttctttttcttcttatttcggtcattatccataaagatagatataaacaagatcaataaccgtaaagacttttattgtcatgtacatgttgaaagtaaaatttcttacgtttcttgtgttcatattatgttttcttcttccgagaattttacgccagctttgtgttgaattgctgaaaaagacattaagttcgactatattaatactcaagttgaaattgaaattagttgcccttttgtcaaattaaaaatgtcaaatatttataggttcttcaactacaactgatatgaaatgatacccgatgagtgacggggcttcttccaagtgggaccttcgcatcctccaatttcagatatatgtctattgttcacaataatgatatattaaataaagaaatattacaaaaataaccacaaatatatattatgtctccgtatcactcgcatatagataaccacatattacatcaatgatatataaaaacaaaatgctatatctttattacaaaaactaggttagaaacccgtgtgttacacggttgacaattcataaaacaaacgtaaacaaaattattttgtaaggcacttatatgccaaccacttgaacatttattacaacatccgacagtctccccgttaactgccacacaaacacaacttgtttttggcaatgcactttactcctttaacccgtaatacactatttttacccataatagcaaggtacttacacatcttttccgaaattgactatatataccctaaaacttgtttaattgttacaagttcaagttacttattgttagtattagtgaagaaatgtaaatacattgctatatggttaaaaaaaagtgcaaagagatggtatactaaaaagtcaaaatgtcgcctaacagctcaccctttacgttaagggtgatagtctttcttacaatcttaaatgtaattttcgtgacgagggacgtgtcaaccgatgctaaaaaaatttgatgatgctttattggtatgcattctttccatttctataatattaattatttaatgtttttatatgttttcttaaaatggtccaaagttgtttaaaactacattttctttactcacataatccgtctatttaacattgtagcatctgtccgacaaccaaaatcatatattaatgagagtaaaataactaatagctaaaatgttccaagtattgaaaaattaaagataaaacgtgataataggatagactatttggagtaaaattcccgataaaaaaattatgggtaaactttgtcctagggttaactgatttttttttcagttttgttcccaaaaaggaatcagatatttctaaaatggcctttagctattacaaacccaaatgacagttctacaacaaataaaaccaaaatgacaaaaaaattacgaaaaggaaaaattttctgatatgatacttaaatattgtttttatttaacctgattttagtggctgctttgaagaaactaataatttattttgggtctgagttcaaagctaaacttgaccatctgacaccagcacttctgactgatgcatctttgtggtgaaactaaggcagaggaagagtaatcaaagccatcaagtattggtccatcatctttcttaacaccttaacctcttgggtacatgagaaagaattaatatacggataccctataacactacaaggattagtggttttagcggcgacataagtcgcccctaatagtccagaaagtcgcccctaaaggcattagcggcgacgagtcgcccctaaaagtgtcgctcctaatgcctc

SEQ ID NO: 63 - DNA, 5618 bp, Cichorium intybus
  source 1..5618: /organism="Cichorium intybus" /mol_type="unassigned DNA"
gtattgtcaacatcaacaacctcatccgacttccaattagcaagtgaccgagtatgcttcacctttttgtgattaaacccctagtataaagaaaacacattcagaatacacattttcttataaaatataaccacaataatacctcttcacttaatccaatttccaaatgtgatcgataaggcttgaaactttccccacagacaactattggtacatcatcacatttcctgacgtcctgtatcatcataaggtcatcaagatgatcaaacttttcatattagaaaccacaaccattattatttaataacataacgtacattaaaagcctgtcttcaacactgtatctcttggttaccagaacatcgttaattgtattctcgtcgtcctacataatcagcaaatcatcaacatggttaaacttttcatattagtaaaccacaactactattattcaatcacattgcgtaccttgtcaagaggctctttagaactttgacttttgtcaaccacataatccaacagagaaactgtccttcattagaaagaaaatagaatataaacaaatattcgtattcatgtgacaacttcaatataaaaattagacacattgattacctcaatatcattgataactatcttgcatacatcctcatcggaccttcgcttgcagagtagaccccccatgtatgccatatcctccaactacgtaaactcataaaacaacatctgttatatctatgtattaacaggaacatcaacccagacaaaacgaaaaccatttagttccatgaaaatcgtcaacctcccatacgtgggtctaaactgaagccacgacctgaagattctccacaaaaagtgaaccctccaaataactgtcacttctaaccgtatatgatgatttaacacggttgagattgaaagttgggaagatcgaacggccataattattggagaaaaagtaggacttattaggaacattagagatataatttgacaatccctccgtaattttataactttctaacgttttgttttgttagctttataaattaagacgttcaaacaaaaaaaaaaaaaaaaaaaaagcactttaaagtaaagtatttctaccgcatgatattattttccaacatcacctttctttctttgtccaatattatattaaacaaaacaatgtttatgatataatcattctccgttctataaaaagaattagtcttctatatacttgatgtgattagtgtagtaatttatacgaagaactattttcacctgtatgaaacaaaaacaatgatggtttttgatggtggactaattaacataatatttaaatatagaaagttaataagcaacaaccttaactaagaaattatgtcaattaaatacatgaacagaaaattaattcgaagaccaattcacttggtgtagtaactagtaactcgtaacattatgctgacatttaatcttattatataaaataaaaaacaaaactctttatatgataatttagaccggcactcgtttgcaagacataagaattagtcaacatttcatgtgattctcacttataataaacaaagtaaaaaggagtaaattgcaaaactggtccttgaattttacttaggattaaaaattcagttaaaattttgaaattatcacgatgtcgtccataaatttgaattttgttgatatgctctctgggattttctcaacagtacacgtttattctagattttaaagtcatattatatgtattaggatttaggaaccatatttgcgacaaaatacaaacttaaagaaggatattataacaatttgtataattgcaatatttggtaaagcacatggacatatttgtaaactataatagtaatatctatttgaattccggccattcaaacggggtgtgcccgcttaacgtgtatataaacacccctttatttcactctttaggtagcaacattcaaccagttgccacttaactctccatttgaatcaatatggattctcttcaaatccctataccagtctacgctataatcgctgtcttaaccttcgtctttgtggcatggctccgccgtaaaccactcccgccaggcccaatggggtggccaatcatcggcaacatgttgatgatggaccaacttacccaccgtggcttagctagtttggcgaaaaaatatggtggcatcctccatctaaaaatgggtttcagccacaccattgccgtgtcatcgccggagattgcccggcaaatacttcaagaaaaagataacatctttgccaaccggccggccaccatcgccatcacgtatcttacctacaaccgcgtagatatggcgtttgcaaactacggaccattctggcggcagatgcggaagctttgtgtcatgaagctgttcagccgtaaacgagcggagtcatgggactccgtcagggatgaggtggataccatggtgaaggccacagccactaactccggtttgccggtaaacttgggtgaactcgtatttgggttgacccatgatatcatctacagggcggccttcgggtcgatttcccacgaaggtaaagaagaattcatcagaatcttgcaagaatacaccaaactctttggcgcattcaacttggccgactttattccaatgctcgggttcattgacccggctgggttgaatacacgtttaccggcggctagggcggcgttggacggattcatcgacaaaatcatcgacgagcatttgagtaaagaaaagaaaaccggcgatgaaaatgtagataacgacatggttgacgagatgttggcgttttacagcgaggacggaagaatcaacgaaggcggtgatttgcaaaacgctattaacttgacacgagataacatcaaagccataatcatggtacgtaacttatgtaactcgaataaactaataactatagaactttctaatatttaaaactattgttctaaagaagaactatacgtaaattttgcaggatgtaatgtttggtggcactgagacagtggcttccgccatagaatggaccatgacggagctaatgcatacaccggaagcactaaagcgcgttcaacaagagttgactaacgttgtcggtcttgaccgccgtgtcgaagagtccgacttcgagaagctaacctacttcaaatgcgtcatcaaagaaaccctccggatgcaccctccgatcccagttctcctccaccaatcgtcggaggcgacagaagtttccggctatcacatccctaaagggacacgtgtcatggtcaacgcgtacgccatcaatcgtgacaaaaactcttgggaagatcctgatactttcaacccatctcgttttttgcaaaacggagctcctgattttaggggaagcaactacgaatttctgccgtttggttctggtcggaggtcgtgtccgggaatgcaacttgggttgtatgcgatggagatggcggtggcccaccttcttcattgtttcacgtgggaactacccgacggaatgaaaccgagtgaaatcgacatgggtgatgtgttcggactcaccgcaccaaaagcaataaggctagtggcagtgccaactccgcgtttattatgtccattgtattgaaataattgtatgtaagttttttagagtttcattttataaaagatatatataaataataacatggaaatatttttcttattgatcgttgctaatatattcctaaatcaacaaacctagttggaacttgaagtgtttacgggatctttgcttcccagattgtgacgaattgtaaaagtccatatatcacaatggagaatatcgaaaggattattagcaacattgttgaaagaaacaaaaggtaatctctttgtttagctaatggacacatatgacaaacagagtcattgtcatctttattgctaatacaaagatcattgcgtattatcctaattttgtcattagagggatgaccaaatcttgaatgccattgatgaagagaaacagccacatttgcacacacagtggtggatgggatagcatgaaccttacccttgccaattattttcttggggaaaatctgtttgataacagcataatcatgatagaatttgactgttagtaactgtgattcggttaaacaggtgactgatatcagattcagttcaaattgtggaacaaatagtacatctctaagaaacaactcatccgtgagctgtatgtctcctttataatgaacctggatgagactatgatttggtagtcttactctagtgcctctaataaagtgaatatttgtgaaatgcctttgtcattgcaaatatgttatgtagcccccgaatcaagaatccatacatttgataagtaatgtccagaattaaaacttaggattcggtatttacctctagatgctcagggacattggtagtaaccatattagtggaagcaagttttcctgttaacaaggaaataagaccttcacactgttgctgagtaagaccagtaacacatcagtatgtacagaaggttgattcatttcttctttatcaataatagattgttgttgatcaacatcaacagagtttgcacgaggttgattagactgagttctgtatccaggagggaagccatgcaagcgataacacttgtcttgtgtgtgaccgatgcgattacagtgcgtatggagaggagaatcttttcaaaagtttttgaaagactggttagatctagttttcttgttcttgatgggttttagtgcaaacaatgagctaaaatcctaagtttacatgcaccttataaggatctatgtttttctcagattgaacctataactaagaccaaaaataaaaatacaaaagaataattttatacctttttacctttggaagctagcaccacaattctcgtgcctctagtggctgacacccagaatcaggcaagctagatgagcaagagagaggaaggaggagactcctttttggcgtgagaaataggggagtcaggggcctctatttatagtctctaggtgataagcactaaggagtataaatgtcttatttaagatcatgatatgataatgtttttatcagataaaaggatctgcttaccattgctataaaaacccttatgggtttcggaatccaccaggctccaagcctgttatttcgtccaacccattaggttaaccagattgactgttacccacctattgaacaattacaatttaaccactgtacttttaactaatccaattaatcttaaaaataattccaattaatttttgattaattattaattatatattattatttctaattaatatattattattattttatattaatatatcattatttctctctctttattggtcatctaatcatttgctagttatgagagcaacccaaatagactgtgtgtaacacccaaaaattttcgcaacatatttgaacttttaaaaacaacatttataagagaaactatgattttacaaaagataagtatcacaaaaccaaattatatcgaaataaacttaataaagtgcggaagcaaaataataataataatgtcccaaaatggaaattcttctaatagtggtatcccggtgctccaagtcacacctc

SEQ ID NO: 64 - DNA, 5614 bp, Cichorium intybus
  source 1..5614: /organism="Cichorium intybus" /mol_type="unassigned DNA"
  misc_feature 4395..5406: /note="n = a or t or c or g" /note="n = a or t or c or g"
atggtccggtgttatcccacttattttatgctgatgatgcaatttttgtaggtgaatggtctttgtcaaacatgaagaatctgtcccgcatccttaagtgttttcatgctgcatcaggacttaaggtcaattttagtaaatccaaagtattcggcattagtgtgaacaatgatctagtctcgaggtgtgctcgcgtccttggttgcgaggcgggctgttttccgttcaagtttcttggagttcctgtgggggctaatatgaaccgaataaaaaattgggacgtaatcgtggacaagttcaatgccaaattatcattgtggaaagcaaaaaacctatcattcggcgggaggatcacactaattaaggcagtactcagcagcttacctgtttattatttttccatttttaaagtgcctgcaggtatacttaagaagcttgagcggatacgaagaagctttttgtggggtggcgggggtcgaaatcatggaataccgtgggtggcttggaacacagtcatctgtgacaagagttatggcggccttggagtcggatcgctacgtagcctcaacattggactcatgttaaagcggtggtggcgtctcaaatgcaaaccggaaacattatggtgcagaataattagtagtatacacaacttggtgaggaaaccggctcatcatcttgcaaagaggtcggctacaggtgcttggcttaatatcgtcaacatccatggtgacctagaggagtttggattcagttttgacagtttattcaggaagacagttggttccggcaacaatactttattttggcatgataaatggctgaatgatacacctttgaaagattcatatccagccctttatgatttagacaaacggaaaatgtgttatgtttcagatagaatcacgatgcaagggaggcagtgggcttggagatctaatccatgcgctgctgatgagattgaccagatgtacaatttggaccaggctttaaacagttattatccgtccaatcgagaagatacctggaggtgtgtgcttaacagtacagggtcgttcacggtgggggcaattagggaaattatcgataattatggtgttacaagatcaagtataaatgttcaatggctaaaaaaataccattaaaagtaacatgttttgtatggagagcccttttagggaaaatcccgtcagcggaggctttgattaggaggggagtacggcttgattcctcgatttgttcattatgtaaatcaaatgttgaatgctacaatcatattctagttgggtgcagctttgctaaggaagtgtgggggaagatactgcagtggtgtggggacccaatctcgataggagaatcggtggagggactgttacagaacgtggcttattggggaaggtgtccgaagaaaaggagactcttgacggttgtatcttacggtacgttgtggtgtctttggaagtcaatgaatgatcagatctttaaaggtgtatcttgtaattctgacacaatttgtgatcaaattaaagcgttgctgtatacatggataaagtttagaggtggtaagttagacattaatcaggaggggtggaatttatctccattgaatactttgtaatttgactttgtatcggctgtccggtcttgcatctcgctgatcggttttgccttttattttatttataaattgtgttgccggttcaaaaaaaaactgtatgcatttaatgttgcattaaatgcatagattagatattatatgtgttaggaaacatatttgcaacaaaatacaaacttaatgaatgatattataataatttctaaaattgtcatatttggtaaagcacatggacataatttgtaatttatatagtaatatctatttgaattccggccattcaaacggggtgtgcccgctcaacttgtatataaacaaccctttatttcactcttaaggtagcaacattcaaccagttgccacttaactctccatttgaatcaatatggattctcttcaaatccctataccagtctacgctataatcgctatcttaaccttcttctttctggcatggctccgccgtaaaccactcccgccgggcccaatggggtggccaatcatcggcaacatgttgatgatggaccaacttacccaccgtggcttagctagtttggcgaaaaaatatggtggcatcctccatctaaaaatgggtttcagtcacaccattgccgtatcatcgccggagatagctcggcaaatacttcaagaaaaagacaacatctttgccaaccggccggccaccatcgctataacctaccttacctacaaccgcgtagacatggcgtttgcaaactacggacctttctggcggcagatgcggaagctttgtgtcatgaagctgtttagccgtaaacgagcggagtcatgggactccgtcagggatgaggtggataccatggtgaaggccaccgccattaactccggtttgccagtaaacttgggtgagctcgtatttgggttgacccatgatattatttatcgggctgctttcgggtcaatttcccatgaaggtaaagaagaattcatcagaatcctgcaagaatacaccaaactttttggcgcattcaacttggctgattttattccaatgctcggttttattgacccggctgggttgaatacacgtttaccggcggccagggcggcgttggatgggttcatcgacaaaatcatcgacgagcatttgagtaaagaaaagaaaaccggcgatgaaaatgttgataatgacatggttgacgagatgttggcgttttacagcgaggacggaagagtcaacgaaggtggagacttgcagaacgccattaacctgactcgagataacatcaaagccataatcatggtacgtaatgtaattcgaataaattaatttctatagatctttataatatttaaaactattattctaaacaaaagcaatacgtatattttgcaggatgtgatgttcggtggcactgagacggtagcttccgctatagaatggaccatgacggagctaatgcatacaccggaagcactaaagcgcgttcaacaagagttgactaatgttgtcggtcttgaccgccgtgtcgaagagtctgacttcgagaagctaacctacttcaaatgtgtcatcaaagaaaccctgcggatgcaccctccgatcccggttctcctccaccaatcatcggaggcgacagaagtttccggctaccacatccctaaagggacacgtgtcatggttaacgcgtacgccataaatcgtgacaaaaactcttgggaagatcccgacactttcaacccatcccgttttttgcaaaacggagctcctgattttaggggaagcaactatgaatttcttccgtttggttctggtcggaggtcgtgtccgggaatgcaacttgggttgtatgcgatggagatggcggtggcccaccttcttcattgtttcacgtgggaactacccgacggaatgaaaccgagtgaaatcgacatgggtgatgtgttcggactcaccgcaccaaaagcaataaggctagtggcagtgccaactccgcgtttattatgtccattgtattgaaataattgtatctaagttttttatagtttcattttatacaagatataaataataacatggaaatattttacttattgatctctgttaatatattcccaaatcaataaatctagttcaaactcaaagtgtttacgggattttttcttggcagattatgacgaattgtaaaagtccgtgtaatccaggtgtagtttagccatgaaaaactcaatggtcaatataaatggctaatttttacgaaatatctcgattcatgtacgtaattatcggtcgctattcttatactcttcaattttccaccaactttgaaacagacattaaataacaaaaaagggctatttgtaatggattggcgaaggaagtttagctacgaaaataacgacaatgtatttatgattagctagttagcgatggatgatattagcgacggttgcgacaaattatattggtgatggatgtttttcgaatgatgaccaccgtgttagcgaagaattttagggtctgtttggtaacatacaatcatgaaagaatgtaatagacaacgtaaaatggaatgaaatgtaatagaataaattattacatttaattgacatgttgattgactcgaataaatgaaatgagtcattcgaacatattatttgttattaatatataaaaaataaagtaaggtaaatttgataataaattaattcaagtaattttataaaataaattctattatatgaagatataacatactttatttcgttatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatatatatatatatatatatatagtaaattagacgaatggtcactgtggtttgggataatttgtgcgcttgatccttaactgtttttttaactcggacggtcccagagttgatgtgggatgctcgtgtcgttttacaaaccctagtcgatgcaaagcttcatggcgactttgatgatatgtcattttggttcctgagtt

SEQ ID NO: 65 - DNA, 5938 bp, Cichorium intybus
  source 1..5938: /organism="Cichorium intybus" /mol_type="unassigned DNA"
  misc_feature 1..1096: /note="n = a or t or c or g"
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatataaactagttatctacaggggcagaaattaaaattgtactgcagtaatagcaccatatattattttcctgtatgttaggggctttgtgagattgtaccattggaataagctaatttttttcaagatgtgtggtatattgttatttttgtagcagcacccgtagtataaaaaaaaatccataaattttgccaattttcgaagaaaatttgaccagtgacgaggccaccatgtgccctatagcaattcagcccctagttatctatgtaaggccattgggagtgggtatcacggagggaccgtgatggccacatcactaccccatcacggcgtgcacaccgccccgggtgctccgtggtgggcgtgatcgtgataggaagtgatggagatcacggctcatcacacccaatagggttttttccccctttttttcttttttttttaattctcactcaaccaattagaagcttggattttttatttttatggaattatttttatttgaaaaagatgatgtggtgtgatgggtataaagtgtgtgttgtgatggagtgtgatggagtgtgataggggtaaaatcctatgtggcgatgacgtggcgcccatcacatttgtgcaatgtgatggatactcccactagcttaaaaacggaaatacgaaaatagtcaactttccggcttcaagtatataattataatattatataataaaatgcaaactcgttcaaacagagctatgcgctgcatcgcctttcaagttcaactactgcgcaccctgtgtttttatatatatacactcgtgcgctctttctatacctggcaaccttctctcattgcacttcattacccatatactttaagatactcactgaacataaattctttcccggatactatggatcccatgtccatcttactttacgttgtactccctctgtttaccttcttccttctctcccgtttacgccggaaacctcttcctccaggtccaagagggtggccagtgatcgggaatatgttaatgatggaccaactcacccaccgtggcctagctcggttaggtgaaaaatacggtggtcttcttcacctcaaaatgggtttcagccacacggtcgctgtctcgtcgccggaaatagccaggcaagtactccaagtgcaagacaacatcttcgccaaccgtccggcaaccatagccatcagttatctgacctacgaccgccaagacatggcgttcgccaactacggtcccttctggcggcagatgcgtaagctctgcgtcatgaagctgttcagccgaaaacgagcggagtcatgggactccgtcagagacgaagttatctccatgatcaaaatcaccgctgcaagttccggttccgctgtcaacctcggcgagctggtgtttgggttaacccatgacatcatttaccgggcagctttcggttctatatctcatgaaggaaaagaagaattcataagaattctacaagaatacacaaagctttttggtgccttcaacttagccgattttatcccatggctaggatttatcgaccctgctggactgaacacccgattacccaaggcccgagcagcgttagatgggttcatcgataaaatcattgatgagcacctgagcaaggagaagaaaaccggcgacgaagaagataatgatatggtggatgagatgttggcgttttacagtgaagaaggaaaagtgaacgaaggcgaggatttgcaaaacgcaattagactcacacgaaataatatcaaagcaattatcatggtaagtaatttgttgtttaatataatatatttaaaaactaaacaagatagattttcagaaaaacatagatcttcaataacatttctagaaaaggcataaaataattttctattggtttaggtaattatcctcttccatttaagtcgttatccaattcaatgatcagtatgaaaacatgaaattcgatatgattttcaacaaaagaattgtgttaggtgaaatggcaaaacatgacaatattgatcaagtcacactgggatatggatagcttaatactttaatttgactaattgattgattacatatgattactttcaacacactaatacattatgattttttattattagttcaggaaaacatgaatctttgtttaatatatctttaactattaatctagtattgctataaaatcattatctataggatgtgatgtttggtggcacggaaactgttgcttctgctatcgaatgggctttgacggagctcatgcataccccagaatccctcaagcgtgcacaacaagaacttgctgatgttgttggccttgatcgtcgtgtagaagagtccgattttgagaagctaacttacttcagatgtgtcatcaaagaaactctccgtctacaccctccgatccctgtcctattgcaccaatcatctgaagccacggaagttgctggctaccacatacctaaagggacacgtgtcatggttaatgcattcgccattaatcgtgacaagaactcttggaaggatccacacatgttcaacccatcacgattcttacaagatggggcccccgactttaaaggaagcaactatgagttccttccttttggatctggacgtagatcatgtcctggaatgcaacttggattgtatgcaatggagatggcggtggctcaccttcttcattctttcacgtggcagttgcccgatggaatgaaaccaagcgagatcgacatgagtgatgtgtttggactcactgcaccaaaagcgatccgacttgttgctgtgccaactcctcgtctgttgtgcccgctgtattgatcagaaagggccgggtttgagattgtgagaatttgttaatgttgcattgaaacaaattgttctttttcttctttcggtcatttcccataaagatagatataaacaagatcaataaccgtaaagacttttattgtcatgtacatgttgaaagtaaaatttcttgtgtttcttgtgttcatattatgttttcttgttcagagaattttacgccagctttgggttgaattgctgaaaaagacattaagttcgactctattaatattcaagttgaaattagttgtccttttgtcaagttaaaaatgtcaaatatttgtaggttgctcaactacaactgatatgaaatgatacccgatgaatgacggggcttcttccaagtgggaccttggcgtcctacaatttccgatatatctattgttcacaataatgatatattaaataaagatatattacaaaaataacaacaaatatatattatgtctccctttcacttgcatatagataaccatgatatataaaaacaaaatgttatatttttattacaaaaataacaagaaatatatattatgttcttattataaatataacatttaccaaatgatattcattgtttacaaggtcagatcccatatatagtatttatattggggattgaaagaaactcacgcttcccatttcttgtatgtctttttggaaccatatctaattcctttgctctctttcccaccatcatcactcactttacgttatctgtcatggttctccttcaccaagccctggatttcaggtttcttggtccaaccataatttcatgattatcttggtctaaaattcgctctgctcctaccactctctaaccctaaagtcaagcatccacaccactactcaactacaccgtcaccatcatcatccattcattgcctttaaccacctaccgccaggcgccagtggtgccaatatttgaaaaagatggtgcttctgcccttcatcttctcctggtctttgccactcaaatctttatctattccatgcaaacaaaaaatctgatcgatcggggctttcgttttttaaatcgtgtttggttatttagattaggtttttgtggggtttgcacaatatatcgcagaacaaagagaaaggcgtggtgtatggacctctgactttctgtgaatgcattccttcaaactttgaccaagcttttcatatttagctatcatgcagtcttcctagaccatgcttgtttgctgctgcatttcttcaaaaatatacaactcaagcttagaattttttgtggttgttcatatttgtttttcaacaattacaaccacaaatttcctttgattcacacatgaagattgccctataaaagggagtagaaatcagcacatcaaaccacaccaacaaaacaaaaatctcacatcttctcttgtaaatacataagagtttttaaactcttagtatttttattcttcaaacattttgtaaacaccacaaaatatattgaattgtttctcggcttccttcgcccgtggtttttcccgatttgggttttccatgtaaatcctcgtgtctctattttatttactttatttgtatttttgttgtgattataaccgtttgataattttgatcccattccgcattgagctaatattgtctaaagtcaattcggatccgtcgtattttacaacaattggtatcatagcgtccgggttttgatattaacttgttgggatcattttatcaagtaataaatcatgtcttcggtgaaatacgatattccgctgctggatcggaatacccaatttccgctgtggcaagtaaagatgagagatattctcattcagatggatttacacaaggcgctcttgggcttcgaaaggatgcccaatacatggaccgaagaagaaaatgagatgaaagatctgaaggctttatctcaaattcgtttgcacttgtcaaacgatgttttacaagatgttctaaaagaaacatcggcggct

SEQ ID NO: 66-67 - skipped (2 entries)

SEQ ID NO: 68 - DNA, 4690 bp, Apium graveolens
  source 1..4690: /organism="Apium graveolens" /mol_type="unassigned DNA"
gagaatgatttaaggttgggttgctgtgattgttgcttgtggtgggtctgctggctgtgtgtttgtgtttgtgtttgcaggctgcggctgtgtgtttatgtatataggtttgagagagactgtgtttgtcaagaattagttaaacaaaaaacgctaccaaccgctgaaaatttccgcggtccgtgcggagggtattttggtaattaccacggaccgctgaaaatttccgtggtccctttgctgctgttttaattaccaaccgttagatccaccatccaacggtggagaaactgtttgttgtataccggtctacaacaaatgtttgttgtagaccggcccccatatatataaagtcggtatagtggagagaagtagtggatgtagttattttaaaaattataaaaactttactatttttggaaatttttgaaatgtaaataattggaaggggtatgaaaaaaaagtgtaaacaaatgagaggtaagaagggtagcaagtcaaaatttaaaattattttaataaacatactaagaacttcctaaacactactgaactcgaaaaatatccggtccgagtgaccagtgtacttgaattaggtaagttgttggcaatgttttattactctaaacatgattatgattgatccaagttggccgtgatgcaaaattagacgtgtcagccccgctaccatacttagtcatggatgacaccaaaatgtattacaatttaaagtccgttgcaaacaagttagctagactagacttgttttgttctgatttccaggccggctcttgtcaatttgtgccccaagaggcaatagcatcttcatcatacaaattactatttttacattacactttttcgagatgtttaaaaatttggaggccctagaccatcaccttactcgccgccctgctgattccatagtagtatctgttgcttgcctgattattaaaagatttaaaataaaaagttgttataataaattgtatatttaaggaatctgtaggctatcgcatttgtagattcattaaaattcagtaggaacatcaaacctgtctctttctttcttaatccacttacagacctctaatcccatgtcacttctcttcattttgctcctaacaattatctcaatgatatttttcatatcacgttttgggggtaaaccttatccaccagggccgagacgcttgccagtgattggcaatacgctgatgatggcctgtctaactcaccgtgggctcgccaaacttgcgagccgttatggtggtctattttacctccgcatgggtgcccaagacattgtagtcgtgtcgacgcctgatatggcacgtcaaattcttcaaactcatcaagaccaaatctccaaccgccctactagtattgctctggactacctttcatatggcagggccaacatggcctttgctgactacagcccttggtggcgtcaaatgcgcaaaatttgtgtcatgaagctctttagccgtgcacgggttgagtcctggaactctgtccgtgacgagttaaaccatatgctccgagatgttgcatcaaatgctaatcaagctattaatctaggcgaattagtttttgggtttacggagaaaatcatctatcgggctgcgttcggatcaaggttgagcgacgggggcactgaatttataaaaataatgcaggaattttccaaattatttggttctttcaatgtatgtgatttcgttccatggatgagtagggctgatcctcaagggcttaaagctagacttcgcaaggctcgtggatcactagatacgttcatcgattccattatagaccaacacataataaaaaggaagggaaaaaatataggtgacaaggacatggtggacgagttactggctttttacactgaggaaggagaagctaaagctgaatctgatgatttacaggccactataaaactcacaaaaaataatatcaagggcattattatggtaagtggactttcattatgccattgttagaaattacagtgtactgacaaaccagtctatatcataataatttgttaatttcaggatataatgtttggggggacagagactgtagctgccgctatagagtgggctatgtcagagctattgaaaaacccggaggagctcagaaagactcaggaagagctttccaacgtagtaggacttcatcgctgtgtcgaagagggagacttggagaaactcacttaccttaagtgtgtactcaaagagaccctacggctccatcctcccctcccgtttctaccccgtgctgcagccgaggatgtatatgttgctggctactatattccagcgggatccagggtcataattaacctttgggcaatggggcacgacgggaagtgttggaatgatgagccagaagcatttaagccctctaggtttcttgatgtgggagcgccagactacagaaacaacaactttgagttcataccgtttgggacaggtcgcagatcatgtccaggcatgcagctgggccttcatgcatttgaaatgggcttagcacaccttcttcactgttttaactgggaattgcctgatggtatgaagccgagccaagttgacatgagtgacatgtatggactctcagctccaaaggcaacccggctcattgctgtgccgactccgcgcctactgtgtccgatctgttaacaaacttgcaaaataatgtacttgaattatatatctgaataataacagaatcagtttcattaagcgatatgattaagacattcattgagaatcctgttaataaatgaacctctaggtagctgcaaaataatgagaattcctgttatgcctgtttctaacacctgtaacgagatggaccgaatgaatgctaccaagttaaaaagctcatgctatttcggagtttggtgacttctgcgttctaattatgcagaagcattaggatttaggggattctcgaaaggagcgagcagaatatccttagtcaaattgtacttcaattttaagatcatgtaaagcatgctatattagtaagctactcttcataataaaaactgcatggtgcttgtaagattctatgacaaatgaaactggatgatgcaaatgatacaaacacatactaataaaatcataaggtaaatctggtacataaatgaaataagataaagagaaaggtaggtgtaacaagatcaacagcaatgataaaaatgaatgggcaagttgccggtttcttcaatttatgtatagggaaggaacccaaccagtgggtgcagctaggattataattcgggtcgagccgggttagcttataaacgagtcaagttcaggtcagcattgcacgacagctgaggcaaacatcgttcacttcatattaactactctttccctatactggctctattgatgttgtcaatgagcatgtggaaaaaaaagttactctcatataaagctttaaaacaatatcgcccaccgtggggctcgaacccacgaccacaaggttaagagccttgcgctctaccaactgagctagacgggcttgtgctttaatttaccaaacgtaatttataaaggtaatttcttagaaagttttgttttctagtaaagtttaatttttattatattttgacaccgtgactcttctggtacaaagaaaacacatgagctaatactgaaactaatgcaataaaagttgctaagggaaaatagtaccctcttgcttttttcagctgaaatttattttggtataaagtgagcaaatagggataaatataacagtttgcaaggaagatcacaaataaatacaaaaaaaaacaaaaacaaagttgcacccagcaaagttcatgctactccattgccttgttcttctcttttatcttgtcacgcagagatacttattactttgggggtcggcggtatgggtagaggatgtcatcgacacttgcttttacttgattgcctactttccttacatttttcgcaacccctgctgctaccaggcctgcatttcttgtaaacctgaaatgtttgttcaaaattttttaatcgtaagctgaatgtattacatttggataagaactgaaatagaggagaaatttaagaactaaagaacagcacttcagcagtgattgggttttacctttttaagaactcgtcccctacagacactgcaggtttatgtgtctgaggctgtggcgatctacgattatctatataaaacaacagttcgacaacaactaattagaaataaatacaaataacaatgctaaaaacgtacaccaccaacaacaaacagaactatttggagaagattcaatccacaggaacaatgaccatattatatagatacaacagttcgacaactaataattagaaacaaatacatataacaatgctaaaaatataaaccaccaacaaggaacaaaactataaggcgaagattcaatctacaggaacagttacaatattaactatgtccgtattctatattaagtcttcacatcccaaatttcaaacacctaatctttgaaaatttgtttatttacaaatttcatattcctttaggtaatattttatgaaacacaccaccaagaaacaacagcggcgccattttctttccatcagatgtatccccactttgatcacagctactagtcgaaaccacaatatagaatttacccgtatac

SEQ ID NO: 69 - DNA, 4155 bp, Apium graveolens
  source 1..4155: /organism="Apium graveolens" /mol_type="unassigned DNA"
ttaataattattagttatgtgtttggagattctcttgctaatttataactaccataaacaaacaaatcatcatcttctcaatcagacaaaccaaaggtatgatgaccagcatggtaatacaaatcctcgtaatttgaactaatccgcatagataaagattagtaaaatattttttaaaaattaatggaatattgtgaacactatggactgcgaatttggaagggaatacgtaataagcaacatgcgttccaaattcacagaatgaaaaatgagtatataaagaggtacacaccacaagaaactgtagcggtagcaacaaatacaaaattaaatatggaacacgatcatattacattggttcaaagtatactacgatctcctactgccaaaatgacaaccatcttcttctttcttctattactgtgtttgttccttgcccgtcgtaaaccataccctccgggaccgaaagggtggcctatcatcggcaacatgttaatcatggacaagttaactcatcgcgggctcgcgaaaatcgcaactcagtacggtggtattgtccatcttcgtatgggcttcctccacatggtcaccgtatccactcccgatatggtccgagaagtacttcaaattcaagacaccgtttttgctaatcgtcctgcaacgatgaatattagctatcttacttataatcgtgctgatatggcattcgcaaattatgggcctttttggcgtcaaatgcgaaaaatatctattatcaagttatttagtcgtaaacgggcagagtcatgggactcggtccgtgaccaggttgatgacatgctcggaaaggtggtgtctaattcaggcttgtctgttaatattggggaactggtgtttgggctcactaggaacatcatttaccgggcggctttcggatcaatatcaggccagggtcaagatgaattcatcaagatcatgcaggagttttcgaaattgtttggtgcttttaatatatgtgattttgttcctgggataacctggcttgatccacaagggtttaaggttcggcttgtcaaggctcgagagtcgcttgataagtttatagactcgattctagacgaacacatagctaaccagaagagcaatctaaacggttcaactgacgagggcaatggtgatatggtgtaccaattattggctttttacagtgaagagcaatctaaagtcaaccattctgatgatacgaacaacgccctaaagctcacaagagataatatcaaagccattatcatggtcagtgcaaccttgacgcatctattagcatgcatatctattttcatatatatgttaatatgttaaaagatgcacacatacaaagtctgctcaagtaccagttttcctttataacatgatgtaaaggatagagctgaaaagagtatatttctagagtaatgtgtagcaattgcgttcactattggttatgcacatatccaaacatggtccctctagacaacaattagatgttttcctcatggtttaattacatgttcaggatgtaatgtttggagggactgagacagttgcgtctgcaattgagtgggcaatgtccgagctcatgggaagccctgaagacctaaaaagggttcaacaagagctcatagatgttgttgggctacatcgtcgtgtagaagaaaatgattttgacaagcttatttacttgaaatgttgtatcaaagagactctcaggctccacccgcccattccattactccttcatgagacggcccaggaagcggtggttgctggatatcacattccagcaaagtcacgggtcatgatcaactcatgggcagttaaccgagacccaaactcgtgggatgacccagaaaagtttaagccatcaagatttttgaaacaaggtatgcctgactttaaggggagcaactttgagttcataccatttgggtcaggtcgaaggtcctgccccgggatgcaactaggactatatgcatttgagatggctgtggctcatcttctgcatagtttcaactgggagttgcctgatggtatgaaaccaagtgaattggatactaatgatgtgtttggactcactgctcctagggccactcggctcgttgctgtaccaactccacgcttgttgtgttccatctgttgatacatatctatctatcgagagagctgagagaaattctataaatatagttccaacaaaatatgtgttaaatttcctgacaaaataaaaagaaatgattgttaaatttggaaatattgttttaaaatgtgtaatgttggctagccataagtgatttttaatgaaattttacatgttcaatctctggttttagctatagcggaaattcatgtatatgtgcgattctcttcttttatagtggagtcgtgtaataattattacataaacttttattatgatatatttctccaactctgtatgttatgctttctgaatgtatgtgagttactataaagtttgagtaagacaatgcttaaatcttttcgtcaatggtattgattacctcccttgtgaacaaaattatatggctcattcaaaccttcatctcattccagttctcactcggggcggtcagaatcactgagaattaatcaacctcacaacatcatgcaagttcagcaagttgcaggattaggaagtaatgcttctaattattaggtaatttcagctgtagtaagggtagcttggtaccttcataaacgtataatgttggctagctacaagtggttttgaataacaagttatatgtgaattatctggattcagatatagctttatgaatggtatgaacttccctgtatttgccattctcttttttctggcggtaataagctatatctgttttgctttctgactgtttgtgagtgggtaataactctcaaatccgtttccaaaacttgtcatgaatgacgcgtgacatttgtaacattttaatttgtgggcgcacatggagtccatctcttgttattaacaaaaaagttaccaagtatttgcataaactgttgtatcttaaaattgattgaagtttggcgctaccaagacccttgctttgaccattcctgtaaatttttatgtaacactttggagtgaaaaaaaaatgaaataaatgcccggagaaacaaatatttgatcctcacaagcttcttcctggtaatatattggttaacaaacggtgagaaccttttcctaagcatagttcattacctctcggattgacaactaacattttcgctgatttcggtctcttaacgttgatgcagacacactaaccttctgaatacttagtaataacaccagatgaaggataaaaattagatattagcaactactcagaagagagataagagttaacatacacaaaagtttcttggtgcatgctttcacgatcaaactcgttggtgaggtccaaagcttttcggcccgattcactaattaatcacaagctctctagaatctagaaactcccattgcctactactacaaagttataacaagcaatagtcaacagacatgacaagaaatttcttgattgaaatttcaagtttgaaccttcaacaaactatacaaagagatagtctgcacgccatgtaacttactggatctcttgacacttctaagcgtcacaaactcaagatttttattttaatattgctttcttgaattttcttcttaacatgctgggacatgctcagtttcaaccttcaacaagcttatttatagctttcaacgtctaacaagtaacattatgaatataatatcatatcaattccataataacctcatgtgtatttatcatattacagggctgacacaacaaaaaaatttcgacaaggttaatgtcatattcccacagtttaccagttaacctctacagaggtgctttgccgatgatactgaaaaggagaagaagcttaaatgtgccttaaacttgtaaaagccttcttctccttttcagtatcatctgcaaagaatctctatcgaggttaactggtgattcacattgaaaattttatctacagatgtgaccgatgatgaaatctgcatatgtgttcgataaaatcatcaaattctctatgagtatcacctccttccgccactgatcttttgacagcagtccccaactc

SEQ ID NO: 70 - DNA, 1536 bp, Apium graveolens
  source 1..1536: /organism="Apium graveolens" /mol_type="unassigned DNA"
atggaaaccaacactaccgccatgacaattctcttcttcattcttccgctgcttagtttctttctcttgtccagctttcgacgtaaacgttaccctccaggcccgaaaggttggcccatcatcggcaacttgttgatgatggacaagctatctcatcgtggactggctaaacttgctgctcaatatggcggccttgtccacctccgtatgggttttcttcacatgttcaccgtttcgactcccgatatggcccgagaagttcttcaaattcaagacaacatttttgccaaccgtcctgctaccatgaatattagctacttaacttatgaccgagcggatatggctttcgcaaattacgggccgttttggcgccaaatgcggaaaatatcggtcatgaagttatttagccgtaaaagggcagagtcgtgggactctgtccgtgaagaggttgatgacatggtgaaaatcgtgttgtcgaagacggggtgttcggttaatattggagagcttgtgttcgggttaactaggaacattatttatcgggcagctttcgggacgttgtcgcacgaaggccaagacgagtttatcaagatattgcaggagttttcgaaactgtttggtgcattcaatatctgtgattttgttccgggattaacttgggcagatccgcaagggttcatgggtcgggtggttaaagctagagcatcgcttgatggattcatagactcaataatagatgcacacattgaaaaaaagaagagcagtaaaaatggtattatcgacgagggaaacagtgatatggtgtatgaattgctggatttttacggtgaagaaaaggctaaagtcagcgagtttgaagatcagaacagctccttgaagctcacaagagataacatcaaagccattatcatggatgtaatgtttggtgggacggagacggtagcatctgcaatagagtgggccatgtcagagctaatgaggagcccaaaagacctcaaaaaagtccaacaagaactcgtcaatgttgttgggcttcaccgtcgtgttgaagaaagtgatttcgacaagctcacttacctcaaatgctgcataaaagagactcttagactccaccctcccatcccactacttttacacgagacggcccaagatgcggaggttgctggatatcacattccggcaaggtctcgagtcatcataaactcatgggccatcaacagagacccaaactcgtggactgacccggacacattcaagccttctaggtttctacaagagggtatgcctgactttaaaggaagcaactttgagttcataccatttgggtcgggtcggaggtcttgtccaggcatgcaacttggactttatgcacttgagatagctgtggctcaccttctgcattgttttaactgggagttacctgatggtatgaagccaagtgaagttgatactgatgatgtgtttggtctcactgctccgagggcgactcgacttgtggctgtgccaactccacgcttgttgtgtcctatctcctga

SEQ ID NO: 71 - DNA, 6688 bp, Brassica oleracea
  source 1..6688: /organism="Brassica oleracea" /mol_type="unassigned DNA"
acaatctggattcatgtgtgatttttttaaaatatagatccaatgaacctattcctagaaagtcatattacatttaatctataatcttatcatttaaattttggatctaccagaaacttttattggactatcaatagttagatttaaacagtggatgatctattggatttatagataatataattaaatagatataatttaatgttgtaatattatacctctatatgttaaatacttaaatatttgtctatgttattttttaaaattataaaaatcttttttttaaataataaaaatcatattatctaacaatgattaatctttactaccttaaaccaatgaaaacaaattttaaactatatagtttattttaaaaattaaacaaaaactaaatgtttaattatttactcgataatataaatctatgaagagaaaagtttaatttcttaataactttctaaatttgtgaaatgttacaatatctttgaatatgacaatacaataatattttactaatctttatatatatagttacgattttaataatgaaataataatccgaaaatatatatatataagaagattcaaatacatgtgaaagtttgaaacaatctattcaatgaaaaaaaaatactgtaaacttattatgttttaaaaattgatagacacatatatattataatatatatcaatttagaattgaaaacaaaatatttatataaaaataaatgaaaacaaaaacccgcgcggtttagcggatcgagatctaatcttatatattaaaacagaagtcaaaacattgattcatgtgcgattttttaaaaaatggacactcaatagaaatcaattatcattcatttattactaataatatggattaataatatatcattcctaatataacatcgactcctaaaaattcggattggttaacaaactcaccttgattcatgtgtgatattttaatttggatcatcatttaaattttttattaaatgtatttacttaatgttaatatataatcttttaactacttaaatcatgatataatttgatatcttttaatttaaaatataaatatatatatttattttttttaacaaaatgtgttgaaaaacattataacaatatcttaattatcaaaaattgtatataaatatttttactaattttgtaattagtaatgaaattaatgttattatacattaatatatatactcagttatcttttataaacattatatttaactatttttactattttatagttatatctaacattttaaaataaaatattgtatttaactaaatatgataaaattattttaaactgataaattaatatattttattttcacaaacattaaaaaatttatgctagaaatataatatgttggtagaacgggttaacattagtaaattagataattcatgtataaaattaacttatcttaaatttttatatatttatagttattatcttaaatgaataaacataaaaaatattgataaaagaaatctagcgctttgaattacggatcatgatcataataattgaataaaaataattttaaaatatatataataaaaaataccaaatatatgtgatgatttgaaataatcaactaacttacagcataaaaactatcaaatttttatatttaaaataattatatataaacatttaaatatatatgtaagtaacttaaaaaatatattctaattatgtaatatatatataaacatgaaaattaatacccgcatagttgtgcggatccaaatctagtaataattaaaaagaggtgtatgtatacatatatatgtgtcacgaaaatgaagttcccatataaaattagaaatatgcaataagtgggaccacactttgattataaaaccaacctttcgtaacacatcccaaaatggcgaactttgcctgatcaattcctgagaccttccacaaacaatagaaaaaacatttcccagaaaaaagaaaaactaatatggagtcttctatatcacaaacactaagccaagtattagatcccaccacgggtattctcatcgttgtctcacttttcatcttcatcggcctcatcacacggggacgaaggcctccgtacccacccggtccacgtggttggcccatcataggcaatatgtcaatgatggaccaactcactcaccgtggtttagccaacttagctaaaaagtacggtggcttgtgccatctccgcatgggatttctccacatgtacgccgtttcctcgccagacgtggctaggcaagtccttcaagtccaggacagcgtcttctcaaaccgaccagcaactatagctataagctatttgacttatgaccgagccgacatggcgtttgctcactacggaccgttttggagacagatgaggaaagtttgtgtcatgaaggtgtttagccgtaaacgagccgagtcatgggcttctgttcgtgatgaagtggacagaatgatccggtcggtttctagtaacgttggtaagttcgtcactctctatgtgcggttaaatattttaaaagtgaacaatcatttttgttagtttattatgcatttgttttctgtgatatatgtgtattttaatagtcaaccaaaaatatcgtaggtaagtctatcaacgttggtgagcaaatttttgcactgacccgaaacataacttaccgggcagcgttcgggtcagcatgtgaaaagggacaagacgagttcataagaattttacaagagttctctaagctttttggagccttcaacgtagcggatttcataccgtatttcgggtggatcgatcctcagggaataaacaagcggctcgtgaaggcccgtaatgacctagacggatttattgacgatatcatcgatgaacacataaagaagaaagagaatcaaaacagtattgatgctggagatgttgttgataccgatatggttgatgatcttcttgctttttacagtgaagaggcgaaattagtgagcgagacagcggatcttcagaactccatcaaacttacccgtgacaatatcaaagcaatcatcatggtaaatatttttcacgaggcactagtaacagtcattattcttaatgcgttacgtcataaaactcatctattaaaccggttgttttctctgcacgtatatattttctgtttttacaagtagtctaatataatattagagaacttgcgtatgcagtcgttttattgatagtagaaaaatacaaaggttttacgtatatcacacgtaaataaaatcaccgtattggaaaacatactataagaacatgattatagagaggttcttggggtgaagtttttagcggaatataagaccatgattatccctaagggtttcttaacaattttttttttacacatcttttatctaaataaaaaaaaaaattaaaaaacataccaatcgcgggtcgtcgcgtatcggtgggacccgcgaacagtccaccaaactcatcacaatcgatccttatcctgcatcttttgtgaccgttttttaaactttttgtgggccccagggctaagaaacacttacaaaactaccgatatttatgctctaagaatccgtctcttaacttttaactaaaaaaattataaaaaaattaagaactagttcttaaataagagttttaagagacggtttttatcgtttttgattaaaaattaatagatgagtttcttatatttcgctaagaactccaccctaagaatctccaggtaatcatgctctaacgtcatgtgaattgacttattttactttttcgataggacgttatgtttggaggaacggaaacggtagcgtcagcgatagagtgggcattgactgagttattacggagcccagaggatctaaaacgagtccaacaagaactcgctgaagttgtcggacttgaccgacgtgtggaagaatcagacatcgagaagttgacttttctgaaatgcacactcaaagaaaccctaaggctacacccaccgatcccactcctcctccacgaaaccgcagaggacactgagatcgacggttacttcgttcccaagaaatctcgcgttatgatcaacgcgtttgcgattggacgcgacaagaactcttgggttgatcccgaaacgtttagaccgtcgaggtttttggaaccgggcgtaccagatttcaaagggagtaacttcgagtttataccattcgggtcgggtcgtcggtcgtgcccgggtatgcagctcgggttatacgcgcttgaactagccgtggcccatatattacattgcttcacgtggaaattacctgatggcatgaaaccaagcgagcttgatatgagcgacgtgtttggtctgacggctcctaaagccacgcgtctctacgctgtcccgagcacgcgccttatttgttctgtttaagttatggttcgaagcacgtggcgggtgaaatgaaaggtggttggtatggttgatggttcttgaaagtggtgtgagaagtcaaacgaagccctgaaaatttgttgatgttatataatatatgtttatgtatttgttgtgtacacacgtgtgttctggatgaaacataaagtggctctttgtttcgtttttcatcttcttttgtgggaattttttccttgcatgaaatgtaaacgctgaaaaataagatttttttttacaactaatttgcatattacaaaagtatactaatgatccaaggattttgcaaacataagcatttccatcactatgagtccagaaaagagtttggcaaccggtgaactaagtgaaaactcatcaactttactatttgaggaacctaatgttagagaaatttggaggcgatagctttcaatttttagttttgaaaagccaattattttcgtgtagttttttaaaaagtcagatcacttgatagaaaaagttaaattctaaactcttcacgtattttcttatttaattttattttgttaaggtcgcgtcttctctattgaaaagttttatagtatatcttatatactcattcatatggaaaaacattgtagtctttattgaaaacgcacctatcatttatgtatcatgaatgtatgtgttgattacttaattttaacaccatcgacgatcagatttctagatggatggcaaaatccatgtttaaactactcacttaaaaaataatgtaacaaccagaatgcatcaagtactaaacgatccctacttcaactaccttgacgaaatcaataaattacaattacttagatttttcgtagctacacgtagcacattcattaacatatatgtagtactatacgtggactatcgaatatcacaaaataattgcaaacatatggttatcagtattaaatatgccccctgaaaaatattcaatcatatagaaaatctccgaaagataagaaaatgacaaatttatagacaagctacaagctgtgaattatgaagcagtcatcgctaatattagctcaaagccaaacctaacatttaaggcttgaatatctaagccatagctttgtaaagaagtttgttcgagtagggtttgtcattgtcttctagataagacacacattttaaattaaaataaataatatattataagtagaattattataaagtataatattatttacctcattaaaacctttttactgctgacaaattttttttttttactactattattaatcataataacgcaatgtaaataaaattaattttaaatgtatagaacaagaagtttatataatatattataagaatattattataaactataattttattcgactcataaaattatatttataatttatataattttttaaaaaattactaatattattaatcataacaacacactgtaaataaaattaattttaaatgtatagaaaaataagtttatataatattatgtcaatttatactacataatttttacttatcatatcataaagaactaaattctaaagtgttaatgaaaatgaatagattgtttactattttaaaattaactaatgttttatttactagcaattcataatatgaattttaaagacaatggatatatctatacgttgtttggaaaaagtaaacttaaagatgaaaatataatggaaagaaataaggaaagataaaagccagttcaaacaaaaaaaattaagaaaatatagataaaaaaaataagtatggaaaaaggtaaaaataataaaactaaagcttgtaaattgccacacagaacttaaattaaattcacataaaataatttgtgagtagatcgaactctcaacactggagccagacgggagcacttttaccaacgaagctacaaaaaattactagaacaactctaactgacaaaaattaaaaagtagtcggaacacgtgcccccgtagcttacactgtagatccgctcctggcagtaccaccaaaaattgagaaggcgcttaatttttgacttttaaagcatttccaacccaactccaatttttactctaaaatgaaataaaagtagatataaaacaataattggcggtgcctccttgacttcacattatttcgtggtggaaggataagaaaatgacaaatttatagacaagctacaagctgtgaattatgaagcagtcatcgctaatattagctccaagccaaacctaacatttaaggcttgaat

SEQ ID NO: 72 - DNA, 6254 bp, Brassica oleracea
  source 1..6254: /organism="Brassica oleracea" /mol_type="unassigned DNA"
  misc_feature 1..1557: /note="n = a or t or c or g"
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagggtttagggtttagtgattaggatttagggtttagtgttattaaaatttagtttttaatgtatgatttagggtttaagatattccaacggtttagagtttatccaaagtttaaggtttaacgtttagggtttaggatttagggtatagggtttagtattttgctgaagacttaacaatattaattaatttatttttttgtaactatttttatgtatttttattattttattttaaaaatataatctaatttggatatttaattttatttctttttttaaaaaatatcaaatatcaaatattcaaacactattggttggttcagaggtgaacccaaaaatttgaccacaacttgattataaaacccacctctctaatcacatcccaaaatggcgaactttgcctgatagacctcttacagaaaaagaaaaagaaaaatcatggagtcttctgtatcacaaacactaagtcaagtattagatcccacaacggctattctcatcgtcgtctcacttttcatattcatcggcctcatcacacgacggcgaaggtcttacccacccggtccacgtggttggcccatcataggaaatatgttaatgatggaccaactcacccaccgtggtttagccaacttagctaaaaaatatggcggcttgtgccatctccgcatgggcttcctccatatgtatgccgtctcatcacctgatgtggctcgacaagtcctccaagtccaagacagcatcttctcgaaccggccggcaacgatagctataagctatttgacttatgaccgagccgacatggcgttcgctcactacggaccgttttggagacagatgaggaaagtgtgtgtcatgaaggtgtttagccgtaaacgtgcggagtcatgggcttctgttcgagatgaagtggacaaaatgatccggtcggtatctagtaacgttggtaagttagctatgtgcggtaaaatatgtaaaaagtaaaaacaacaaacaatgtttctctcttttatacgtattttaacagccataccaaaaaaaatgtaggtaagtctataaatgtcggggagcaaattttcgccctgacccgaaacataacttaccgggcagcgttcgggtcagcttgcgaaaagggacaagacgagttcataagaatcttacaagagttctctaaactttttggagccttcaacgtagcagatttcataccatatttcgggtggatcgatccacaagggataaacaagcggctcgtgaaggcccgtaatgatctagacggatttattgacgatatcatcgacgaacatatgaagaagaaagagaatcaaaacactgttgatgatggatatgttggtgataccgatatggttgatgatcttcttgctttttacagtgaagaggccaaattagtgagcgagacaacggatcttcagaattctatcaaacttacccgtgacaatatcaaagcaatcatcatggtaatttctttttcaaaagaccactaggcacattcattattcttaatgcgtcacaccatcgaacttatccatcaaaccactagattcatatttttgtctaaatgaggaaggtaactttctgtatttacaagtagtccatatgatattagagattttgcgtaagcattaggggaaaatgacgtcatttactgatggtaaaaactcataaaaatataaagttttagaaaagacctaaaatacgaaacatgtaaaaaacacgtacaaaggtaatataaatcacacgtaaatataatctgaccgtctttgagctaacaatttatttctgtttacattttaaaatctaatttgaattgatttattgaatttaataggacgtcatgttcggaggaacggaaacggtagcgtcggcaatagagtgggccttaacggagttattacggagccccgaggatctaaaacgggtccaacaagaactcgcagaagttgtcggacttgaccgacgtgtggaagaatcagacatcgagaagttgacttttctgaaatgcacactcaaagaaaccctaaggctacacccaccgatcccactcctcctccacgaaaccgcagaggacactgagatcgatggttacttcgttcccaagagatctcgcgttatgatcaacgcgttcgcgattggacgtgaccctaaatcttggcctgacgccgaaacgtttagaccgtcgaggtttttagaaccgggagtagctgattttaaaggaagtaacttcgagtttataccattcgggtcgggtcgtagatcgtgcccgggtatgcaactcgggttatacgcgcttgagttagccgttgctcatatattacactgcttcacatggaaattacctgatgggatgaaaccgagcgagcttgacatgaacgacgtgtttggtctcacggctcctaaagccactcgtcttttcgccgtgcctagcacacgcctgatttgtgctgtctaagttatggttcgtagcacgtggcgggtgtaaaaccaaacgaagggttggttcttggaaagagtttgaaaagtcaaatgtagcactgaacatttgtggatgttattatatgtatgtatgtgtatcacgtgtggtctggatgaaaacataaatggctctttgtttcgattttccttttcttttgttgggatttttccttgaatgaaatgtaactggtcaaatatagtttttttttgtttatctacattacctttgcatattacgtaggtaaactattaagagtattgcattcgttagaaattttataacctaccgacaaatttccatcaccatgagtctatgacttaaaagagtttggcaacctgtaaaaccaagttaaagctcgatttgtattttaaaccagaagttaacccgcgctacgcgcatagttattttgattttcaaattttaactatatagatattcatttggaccttgtattctgaacaacaacaaaattttgaattgtatgtttgagtgaatacatatttacttagaaaaaacaaaaaattatatatatttttcatatagatatttgataaagtttttcatttattatattgtatatttacttattatttagtttttcttatattgtagggcaattctatcaaataacatttttaagttttttcacaaaatagccatcaataaagaaaatgaccaaaatagccccttttattttgaaaatttattttaattttaattttttttaaatttaaaaccatatcctcaaaactccacctcttaactctaaccctaagtatatattatttaaccttaggatataaatgtatttttactctttaataaaacttcttttggtcatttttcttattgagaactatttttgtgacaaaaatttaaaagggttatcttaggaaatttctctatattgtatatttatttattctaattttcttacttttatatcaaatggtaatattaccgagttaaaactcaatttgtatttaaagtttagatattgtttttttttttttgataaccgagtgttttggctccaccgtggtggtccagactagagaccgaagcgagcaaggacgctgccaggacgtcaccatgtggctcatcgtgaacggttttcgatctcgggcactgggggatccgcatgtaaattttccagtggctgggtttcgaacctaggtggcggaactcacagccgtgagtcctttacaccagagctagataccacggttaagtttagatattgtttggtatacgaatatgtcacttttcaatttatataacaaaatgtcttttgacgacaacttttattagtttattagatagttatgttttttcttttatatgaaatgtatatgtcattatcataattggtgtattagaagatggtttcttaaaagtaagaagttctgaaatttgtggtgaaacaactgtatataaaatagctgtagaattcttccttttcttttgaaagcctatttgttttcttggtaggattagatacgtaacatgatagtacaataacatgcacctaccatttacgtatgtgttaataacttaattcaaacaccatcgatggtgcaatttctagctgaatatcaaaactcatatccaaattattcatttgctgagaatgagttgctctaaaaatccaagccagggatcaactcctctcaacataaaaatttatttagccagttcaaataatgccatatattaaaaattcagtgaatcacgactacactcaccctgaaaaattatatgcgtgttaaaagcccaaatcaccttctagttataaaactattcacttataaaatatttacacatacaataattagctagaagtattataacagccataatgcatcccgtagttattgaatttatcattgcatctaccttggcgaaagcaataaattgcaaatcactcaaatacgttagatttgcagtagatatacacacgtagcacattcatattcacgtacgtatgtaccatacgtggattatccaatatcacaaaataattgcatatattattttcagtattgaatattctctctgtttcataataagtgtcattttaacatttttttgttataaaaatagtgtcattttacaatttcaaacaaattatacttatttttagttgaaaattaattgaaaactacattgattttataaataattttattatctcaaat

SEQ ID NO: 73 - DNA, 5858 bp, Brassica oleracea
  source 1..5858: /organism="Brassica oleracea" /mol_type="unassigned DNA"
aaatcctaaaccattactccttttggtatgaaaccaattcgccgcgtgctctggttgaattgataatctatagcaagtggtttcacggtcaaactcctcatggttgcaaagatatccttctttgaatgcacctacgtcgctgctggctccaatgtagcttgtatggttgatctcatggagttggtggtccagctactgacttgaggtcctcatcatgtctccaaggaaacctccaagcttctttcctttacaaggatgtcactcttgttacttcctctatccaaaggtttgcaagggtttgtttcgttattgttacttattattaattgaaaccgtcgtaatattctccttacttatttcaaatcttatgaatggttgatacctagttacgataagctagagccacacatgcctcagattctcaacgtttcagcagttgctattgaataagatttgagcggtgcgattgcggaagagattatgaaggctatcaaagagaggaatcaagtgcggttatctcttacagattgtagagaggaacaggagaaaggtatcataagctatgaatgccatgaaaccacattgcggtttgagccaggctctgatcagattaaggcgactgcatatgggaagcaccctactcatcatcaacctttagcttatactaggctaatacattttgtgatattttcgtattatatactaccattcagttaatatattaaaaaaatacaatacaaagactacaaaaatattggttttcgggtacaatgttagaacctattccaatacgaatgtttctgactatatagaagaatcttttttcccttcaatatagatgctgaacaaatagcagcgtctctttaacgagacaaaacttgtgtccaaaaatatcacaaaacccacgacaagaagccactagagaagacctcgatgaccttagcttgcagtttcagtagtctatgtatgttcaagaaaaagatgttagtttaaaaaagcacgattgggtgtcggaagttagaaacagggacatatcattgatatcaacacatttctgcgatttcttcgtaatacaaagaactttgaaaactgaagtaagtaatttcttctttaaacccaggacatatgggcctacataatagcaccaacgaggcaacgatacaatactcagaaattgcttacttaatttttttaattcatctttttaatataattatttaacggtttttttaccaacgaatcatgctttatacttgcatatatttatttgtttattgtgatcaaactcaaaaactgtactatcacgtagctgtcatgtaaatcttgagaaagctacatagttggtcttacaaagcgttaccatgcatgtactttgttttttttgaacgaaccatgcatgttctttttcgtttgattatttacaaacgttcttttttttgttagattagttccatgtaatttttttcgtgctaaagaaatattagaaattctattcctcaattctcacgccaaatgtgtacggtatctggtttcgtcagaagtattataaactgacaatgctagcaaatgttctttgactagaaaattacatttatatcatttacaaactaaaaaatccaaataaaattttaaatatttgcatataattctcgaacccatagatctattgatctttattgtaaatcttgaatgtagatttcctatccaaactacatattgttctttattaggatattgattattgggatattgactattgacttgttttctctttttttctggtcaaatttgacttgttttttctaaggtaataaatgatctattaaatacccaaaacggaaataaatctttcatttatatattgtttatcatacacatctgtatgtgctaataaatcaaatacagattatacaaccagattcgtgcgtatataaccataccaaaaacttcttatcacccatcttttcgctctttgtatcggaaagaaaaaaacataaaagatggattgtttgctttgctcaccaattttatatgtagttcttatatttctttggtatttagttagagttttgttaactcgtagtaatccatttccacctggtccaaaaggctatccaataatcggtaacatgaaattaaagaatcagttgaatcatcgtggtttggccgagttagccaaacaatacggtggtctcttacaccttcaaatgggtagaattcatattgtggccgcttcaacagctgagatggcccgagaaattcttcaggtatgtggttttctacggtttagaaattgttttgacaatttaaatattcttctaaatattttgataggataacagtgaatttatagtttttgtaagacacattcatcttaaaacattcaattacgttaggttcaagatgtggttttcgcaaaccggccagctaacgtcgccatttcatatctcacttacaaccgggcagatatggcgtttgcgaactacggtccactctggcgtcaaatgaggaaagtttgcgttatgaaactctttagcagaaaacgggccgaatcatgggcctcggttcgcgacgaaattaatacgatggttcaaactctgactaaacaaaccggttcaccggttaacgttggcgagcttgtctttgctttgacgcggaacataacgtaccgagccgcgtttggctcgttcgctcgcgacggtcaagacgaattcgtaaagattctacaagagttctcgaaactctttggagcgtttgatatcaccgagtttttaccgtggatgaaatggtttagtaatcgcgatttcagcaagcggttggaaaacgcaaggaaatcgctggatgggttcatagatagaatcatcgatgcacatatcgaaaagaagaattcaagaaaacaagacgatgatggcttggaggacgacatggtcgatgaattaatggcgttttatagcggcgaaagcggtgagaacggcggcaaatctaatgattcactgtcttcatttaaactcactagagataacatcaaggcccttgtcatggtaaatagtttaaattaatcattcaaaaaccataagttattaatgaaatgattttttttatttaggatgtgatgtttggcgggacggaaacggtggcgtctgcgattgagtgggccatgacggagctgatgaagaaccctcacgaactcgtaaagctgcagcaagaactagctgacgtcatcggattgaaccgtgagtttcacgaatctgatctggagaatcttccttacttcagatgcgcgatgaaagagacgctgaggctgcaccctccgattcctcttctcctccacgaggcggctgcggactccgtcgtctccggctactccattccccgtgactctcgggtgatgatcaatgtgtacgcgatcgggcgagacggatcggtgtggaccgagccggatgcgttcagaccgggtcggtttatggatagcaaagctccggatttcaaaggtagcgatttcgagtttctaccgtttgggtcgggtcgaagatcgtgcccgggtatgcagttggggctttatgctatggagctcgctgtggcgcacatgcttcattcatttgattgggagttgccggaaggaggtagctctgatgatctggatatgactgacatgttcggtctcacggcgcctagagccaccaggctcatcgccgttccgagttaccggctaaaatgtccgatggtgatttgaaatgcgtgttgtttgtttgaagaagttttatatcaactgtttgccgttttttatgattccttacacaaagtgtttgttgttgtttaagattctaatctatttaaactatttggtccggatcttccgattttaaaggtaaattccagattaacaggacacgggaaaaataccgagaaagaaaggagtcattacaaaaccataaatcaattctggttctccttagaacacaagaccggtttgtaaactaagcaaaagctacttagttagtacctcaaggggtagtggtggtggtggttcactaatctcccagaagggcattcatacgcaatgtgtcctcttccaccacagtttcgacatatcatcagcctagccgtgcagtctctgctcatatgacccacttgccggcagttcctgcaaaccacctcctcctccctgtattgggctctgatccctcgtggtcttcgctcttctgctgctaacacatgggttttggggcatttgatagcaacgtgaccagccaggttgcagtgattgcacacgggatcgtctctgcagtcacgagctagatgaccagtcttcctgcagttgttgcaggctttctcgttagtgcaatcagctgagaagtgaccttgcttgtaacagttgttgcagagtctcaggtcaccaggagggaggtggcgagccgtgcagtctttagcttggtgtccggcaataccgcagctgtgacagatgccttcgttggtgcagctattagacatgtgacctggttcacggcagttccagcacacagacttcgcggagcattcagacagattgtgactgccaagttttattagaagaaaaaaagacaaggtatatgttattaagttatcagtgtcggccacagaaataaaatacaaagaattagacatacatcatcaaccaatctaaacacactacattatcaaagcagctaatctacgttcaagattagtgtatattagcactaaaaatgtagcaagaacttcactataacaatctaaatcaacttagaacgtgaagcaaagaccataagaaagaggaatagagaatggatagggtggttacccaggcaggccgcagttgtggcagatagagacattgggacactctcgagcaaaatgaccaggtcgcttacaattcttgcacgtattactttgactgcagcaacagaattttaatgttaagcatatcagtaaaaccaatttagtttctttcttctcggtatacagctaagctatgggtgaagtatactaagagaaatgccagtttcgatgagaaaaacctgaaagtccgatgtgaatctcttcggtaaggatcatcacggtaagaaaaacgatcagaagcaatctttctggccatcgggttcctactcctcctgggtgtaactggatttatcttagcaacaaaacaaacaaacaaacaaacaaaaacacaaccggaaatctgaaacggaagtaagaaaagtcacgcatttggtgtagcgaatacgagatgcaaagtgtgtcttaatagaaagaacgacggaacatcctccactttttaaaacattaaaaatcattccttaacatgcgctaaaaccctaacaactcaatctctattggactcttacaaatcttcaccgataaaattacatcactacctacctcacggcgacgacaaccaactttccgacaagtaaactgtcagcagttcgacaaatctggcttgcggcgaccgaacctgtgttctgtgcgacaccctcgaacacacacaaaataacgtcatcagttggtatcttagtaaatgggcttcaaaagcctttcgtgacccattaacaaagtgagacacgcctgacatgtattaaccaattactgttatgttcggtattcgttcactcaccacttgttcttttctgatacggtccagtctactactactatacgtacaaacatcaaatttgtaacatcatgggccaatatcccatatgcaatgtaaatttctaatgtgcaaacaagagaataaaatatgtgtattcttgtttctgctttaattcataaacatatggagccctttatatataggaaattacatgaaaagaaaaaaaaaagactacgaacatgaaaag

SEQ ID NO: 74 - DNA, 6735 bp, Brassica oleracea
  source 1..6735: /organism="Brassica oleracea" /mol_type="unassigned DNA"
ctcttttaaatttttaccggatcctaatccgtgcggttaatatatttttttttaatttgtaatatttgattgttttacattcacttagtcatgaatttttttagcgtgttaaaccatctattgtacgacgaatattcgatatcatataaataaattcaacatatatatgtatgtaattagaaaattgtatacaatatataaaaataatgtttttaaaatatgaagaaataaagaactatgacttagtgtgccatagaaaatattataaaatagttattcatgtttaaagaaaatacaatttattaaacttctataaaaaaatttacatataaaatgatcgattaataaaatcagggtgttttaagttaaaatttaatttaggcaaagacattaactgaactggaaaaaacatgaattaaataagatagtttaatttaattctcaatggcatggaagtgtaaataactttgaaaactaagagacaatttatattggtacttctctttttttttttttgaaagaattttaaatttattcaaataaaaaaaaaaccttgatacagagattcactgcttccttactacaaatattgaaatcagaaaaacttcaaaaatctcataattcctttagcttcttccaaaccaattctccattgttttttcatgcttccctcctgctttctttctaaacgaggtgattatgttgcgaactatcttgtccaatctatcaatcagacatgaaactggttgggaaggctcacccacccttctcacatttctctcatgccaaatagcataggccaccacttgcagacaatatcgcatcaaaaaagtcatacctctcccttgacatcctttcactattaatagagatgttaacctctacttgtattttagctctaaaaaaccttttcttgtattcgtagagatttatataaagaaaaatctaaagattagtctcttaattttggagcaaattccaaggcttaaatcctatgttttgtttaatgtgatatagtaccaactatttcttttacgatcaggggcggatccaggattatatttaaatgggggcacatgaaaattatacattatattgttttaattgggggcactccttatgttttatactaataactatagaaaattaaaagaccccatacccttggctttgcgtccaccactgtttacaacatagtagaagagaagagaatgtagttaatcaatattatataaaggagataactagatctcttggtggttgaaagccaacaacaaatcattatacgtacataaaaggggcctaaatcatgccaaggaagttggtcactctgccatgatataatatataatactctactaaaaattaattatttcatttatagagcttgtggaatccttatgtatgcacccaccctctttatactagtcttctctgtttcgttttgcttagttatgccatcaatttttgaatgacgaattggattatagaagcaaaatatgatgagatagcgctgtactttctttagtaacatgtattttcaatttggtacatcctttcaaaacgttattgagtacgtaaatgcacaagtagataaccttttcacttgtaagatcaccttagatatgggaaatggaaatagttatatcaatgattattggcatgtcacatgaataataaaataacagtatatcataattaaaatttaaacgctaaaacttaatagtaatatgccgaataataacaaaatgtttcacaatgaccacaaaacaatgtctatacataatttagtgccgtattatttttgtatatatgatctaccacaaaaaagttgttcattttgcaaaagtcaactcattcttttatatgaaaagtccactctttgaaagtttttatattgttaagatgaaaaaaatatactcataaatggggccaagttatggttataaaagctagcgttggccttaataatcacatcatctcaaattagttgacaaactaacaatggagtctctgttatcacaaacactaaaccaagtaatagatcccaccccgtcagttcttcttatcaccatctctcttctagttgtagtctacctcatctcacaatggtttaaaccgctctaccctcccggtcccaaaggcctacccgtaattggaaatatgctaatgatggaccaactcacacaccatggtctagccaagctagcccataaatacggtggtttgttccatttacgaatgggatttcgtcacgtgtttgccatcacatcacctgacgtcgctcgacaagtcctccaagtccaagacatcagcttctcgaaccggcccgtgaatgtagccataaactacttaacctacgatctagccgacatggccttcgctccttacggacccttttggagagaaatgaggaaagtgtgcgtcatgaaggtgttcagccggaaacggaccgagtcatgggcctcggtccgtgaagaagtaaacaatatggtccggtctttttctagcaacgtcggtaagcccgttaacgttggagagctcattttcacattgacacggaacataacgtaccgagcggcgtttggtgcggcctgcgagacagaacaagacgagttcataaggatcttgcaagagttctcaaagctatttggagcattcaacatcgcggattttataccgttcctagggtggtttgattttcaagggataaacaagaggcttgttaaggctcgtaacgatcttgacgggttcatcgatgaagttatcgatgagcatatgaagaagagggagactgtaaacgttgatgaagatacagatatggtggatgatctacttgcgttttatagcgaggattcatcaactaatcgtaataagaacaccgtaaaactcacacgtgataatatcaaagccctcgtcatggtaagccaaaacgttaccttttttatttattgattttcctcttagtaatcatttaatccttgttcacattttctataaatatataagataatttagttgtaataatgtttaagccaaattaaaattatttcgaccaatttacaaaaaagaatatttgaagttgatagtttatacaccatccgttcacaaaaaaagtaaaatttatagagttttcacgtttattaagaatacaataaatatttacaatttaatttaaactttatttttcaatacactttctaataactatctaccaataaaatttaatcaattcaaatattcacaattaatgtttctcaaaagtatacaaaagtatcttaaaaatatagaaaatctatttatttggaacacgaataagctctagaaaatcttacctttcaggaacagatgaagtaatatattgggatgactgatagtttcgataatattaattagtagcaattatgtgttccctctgttcctgaaagtaggattttctagatttattttttattccaaaatgatagattttctaaaactttaagatatttttagtagttaatgttgaaaagttgtatatttttaagaaacattaattgaaaatatttgaattgattgaatactattggttgatatttattggaaaatgtatagtaaattaaataataaattcaattgtaaatatttattatattcttaatatgcgtgaatactctagaaaatctttctttcgggaacagatggagtattacttttcttgtttgtatataaaaataccattttggttttggaaatgatatatatctttgtgttacactgttcggaatcatacatttgatttgagatggaatataaagtagtacagaatataaattattatatcccagttgattatgaatttgaaattcgtgatttttaacggtttttgataactaaaatggtagctcgatatactaattttttttttttgaactattaatttactttattactggaaggatgttatgtttggaggaacggagacaatggcgtcagggatcgaatgggctttgacagagcttctacgtaacccagctgaactcaaacggctccaacaagagctcaccgaggtcgtgggtcttgaccgacgcgtggatgatactcacctcgagcaactaacattcctaaaatgcacactcaaagaaaccatgagactccacccaccgatcccactcatcctccacgaggctattgaggacagaaagctccaaggcttctttgttcccaaaggctcacgcttgatgatcaatgccttcgctatcgcacgtgacccgaagttgtgggttgacccggaagcgtttcgaccttctaggtttatggaaccgggtatgcctgatttcatggggactaactttgagtttatacccttcggggcaggtcggagatcgtgtccgggaatgcaacttgggctttatgcgatggaggtggctgtggctaacatcattcactgtttcacgtggaagttgcctgacgggatgaaaccaagtgagctcgacatgagcgacgtcatgggtcttaccgctcccagagccacgcgattgatcgcagtgcctgacacgcgcctcatctgtccggtgtatccttgaccatggagagagttttactgctctattcaggattaatggttcaaaagttttgtcttctctcttaagatcttgctatctttaaaaaaaatatatatatatatgtttttccacattgggcatgctttgttttttgttcacaggggattttcttcctcaaaatgtaactgtaaataaataataaatagggtaataaggtttttagtaattaaactcttcgattaaagatgaatggtaaataaacccctcaactaaaattttgacgaagaaaacccttaactttaattccgttaacgtttgtcaccctccgtcacagtattttagacggagggtgacagacattaacgaaattaaagttgaagattttttcgtcgaatttttagttgagggttattttgcgatccatctttagttgaagagttttattactaaatgccattaaatattttgaaatatttactatcatttatgcattatttaaaattaggtgttttcttgcacaatgtgcagtaataaaattttttaatttaaattatatttaaaataattttattaatattttattattttcttaccaatattttaatataaatttgatttaattatcaaagtacaactaaactgtatttctaaaatttgaagatatataaaagaagttaataatattacgtttaaaattatatatatattttttagattgtaacaattttgaaaatctttttagtaataaattgtataattataaaaaatagaaataaattattacgaaagtgattattttatcaaatttataaccaatttataaagctttataaatattttactactttataaataattaataaggtttaataataactttataagattaaaggtatggttgttctccataatacaaaaacatgaagtaagtaaataaaagaagaaaagtaaataaaaaatattgttttatttattaataaggtaggagtataatgtattggttccgaaagcaaagagaaaaaaatagtcatgattataattttttctttgatttccgaaaaaaatagtcatgattataattattaataaggtaggagtataatttattgttttatttatttacttcatgtttttatagtatggtgaacaaccatatctttaatcttataaaatcattgttaaccttattaataatttataaaagtattaaaatatttataaagctttgtaaatcggttataaaattgaaaaagtaatgtatatgaatttataaattatcttagaggcttataaatctattgtaagagttacccttttaaatagtgcataagtgacaataaagattttaaaatatttaaaggcatttagtaataaaacccctcaactaaagatggatagcaaaataacctctcaactaaaaattcaacgaaagaaaccctcaactttaatttcgttaacatctgttaccctccgtctaaaataccatgacggggggtgacagacgttaacggaattaaagttgatgagttttttcgtcgaatttttagttgaggagtttatttaccattcatctttagttcatgagtttaattacttaaattcctcataaataataaatgaaataaatttgacaatggaaggattataagtaccttgcatggaaagcaaccccgagttgctgaatttgaagctttaggcctctacaccattttgctcaatttccgatcttttttgtttctgtccagtgttgagaagcttcttctctggttgagcctttggctatatacactacctttgttcttcacaattgaagcatagcggctatcaacgagagtttattaccctacaaagtgtattctgaccatttatgtttctcatgcatcctctagaatctacatatgcaactcaaggaacacagcattaacatacttctaataaatcacacataatgtactcttatagctaatgaatcgagtagacctatcatgaaacattataagtttaaacttgaatttctcagacctagctaacatcaaagcaaactatcacatagagcttggatccctttctgtaagtgatacaaacccccattagttaatgattttgcttgatacacaactttggggatgaaagaattctcttttgcctttagtatatacgtgccttataggtcaagagtttcagagtattc

SEQ ID NO: 75 - DNA, 6472 bp, Brassica oleracea
  source 1..6472: /organism="Brassica oleracea" /mol_type="unassigned DNA"
atcatctcttaaccgaccaggtagaacatccatacgtcctaatgaaccataaatccttcttgtaaatgatcttactctcactctataaaaatgcatgcttatttcacactccaagtcctcatatttaattaaatcagttccataacatgaaacaacatgaaacatttcatgttatgccataatatataacctgcaaatgaaaatgtaaaatgtgagtaagatttttaatagttcacacaccatcaaaatatatatttcctccttaaaacttcatattctatcatatctacaaagtttaagtctcattctatttctccataaattgattatcataaccgatacgctggctaaattttgagcaattacaatttttgggcagttacaattccctagatgaaccatatataacacgaaaagggggaagcacattttattattcggaaagagagattcataatgacttttaattagttctaacaatggagacgagagtgacacgaagatgtgaaaacagaagaagccgatgtgtgtttgatctatttgtatttgcctttaactaaataacatttcctttagataggtatgtttattaaaagattcaaaaaatgcatattatattcatataattttagagttacatacatgtttaaattatgagtgttcatatatatgtcgagtttatttagatacaatgtacttaattaacagcatatacataactttttctaacaaccaatcatgtttgctaaagataaaattcaaaattcagagagaaaaaaacaaaataaagtgaatagttttgaaaccccccttttatttaaaaaatatttattaaacatcataaattgtgttttattaaatccaatttgtgttgttctttgttgatcaatattatttcttgtttagggtattttttcttgttttctttacttttatttatttttctttactttctttacttttatttactttacttgaaattgaatgtgttttttttcgcatcaaggcagaaaccttgtcataatatcttagtacctagtttcaaaaaaaaaaaatcttagtacttgataagtttaatgtttttttttttgaacttcaatatgtttgtttgatgtttggacgtcgttcccatctgttaaaattttctctttacttttttcgtacatcaaattttctttttacttaaattaaatatttctaatcataataatattttttgcaaaagcacacgaggctaaaagattgtctcctataaaaacaatccaaattataagatgaatttaaaatcctttttttgaacggcaatgcatttaaagtccatacatataaaaatgtacacattaccaaacaaaagcaccatcgtttttcacgagtcattccacgatgtgacaaatattgacctaccaataccatcatatgattatactgtccatgtgatcataaaattggctaaacatcgagtgagatcattggttggttttgtttatgattttgttgaatatcatgttgtcccacaaaagattttacgtggatagccagataagacgtcgtcattgcgagacgaggcctaccatcaaagctgaaaaagctaaagaaaaatccaacagtaccatcatactgacaatatattttaacttagacatggttaccagactacatagaagatatgagatctcgcttgaacaaaagattctacagcttaacttcaaatcaaagttcaatcaacaacggattaaccactactaagtttgctccactctgtctcgctcactctaaatgtgctctatgtgcacctcttcaacaaaaaaggtctctctaaagaatttttgtcgtctacctaatttagtaaatatagtgagatgataatgcaaatatacatgccatacaagctacttatcgttttcaccaaaatactatataataagccctaatgatcaccctgagcgttgtgacttctttggttgttctttgcacccatgttcacaagaaacacattattaaagaccaatttcaactaaaataatagaaaacatacacaaaagaggtattagaattgaggtagttgttaagtcgatatcaatcacataatttcttaacagacataaaatagacccacgcacactaacttgtatcaaatgtatactctaatgacactcatccttcttgtccctcttcttctttttcttttccgtcacctcctttcacgacggctaaggcagcggaaaccataccctccgggacccaaaggcttacccatcattggcaatatactcatgatgaaccaattcaaccaccgtggcctagccaagctcagccgcacatacggtggactacttcacctccgcctcggaatttcccatctttttgtagtttcttctcctcaaatcgcacgtcaagtcctccaagttcaagaccacgttttctcaaaccgtccaaccacaatagcaatccgttacttgacctacgggcaatccgacctagcattctgcaattacggcccgttctggcgaaggatgaggaaactctacgttatgatgctctttagccgtaaacgggccgagtcgtgggcctctgttgacgaagaggttcacaaagcggtccgttctgtagcggccaatgtcggaaaaccactaaacgtatgcaaagtcgcattctccttaacaagagacataacgttccgagcagcgttcggctcctcgtcgtccagttctaacgaaggcagactagatgagttccttgagatcatacaagagttctctaagctctttggtgagtttaatgtagcggattacgtcccgtcttggctcagttggatagacccgcaagggataaacaagcgggtcgagaaagcccgaaaatctctagactgtttcattgagtcaatcatcaatgatcacttagacaagaagaagacagaaaagaacgttaacgttgacgaggtgaccgatatggttgaccagttacttgcgttctacaaagaagaagttaaagtcaaggactcagagaccaaaatcaatctcgataacataaagggcatcatcatggtaaaaaattaaacatactccattccatccgtttcaaattatacactattttattaattagtagaatgtgcaattttttgtttatttaactattacaattatgtagcatttattgtttaattttttaattagtgataaaagaggtaaactaataaaaatgtcattaaaatcattaaaattatatttattttaaatcaaaaattttactctatcaaaataatttttttaaataaaatgaaataaaggatgtgatgttcggaggaaccgagacggtggcattagcaatcgagtgggtactaaccgagctactccggagccccgagaacatgaaacgggtccaggacgagctagcgactgtggtcgggcttgagcggtggagcgtggaggacacgcatcttgagaagctctctttcctaaaatgtgtactcaaggatactctccggctccacccgccgttccctctcctcctccacgagacggtggaggaggccgaggtctccggttacttcattcccaagggatcacgtgtgatggtcacacctacgctcttgggcgtgacccggcttcgtggtccgacccggaaatattcaacccgagtaggttcttggatccgggtgctcctgatctgaaaggaaacagtttcgaattcattccgttcgggtcaggtaggagatcgtgcccgggtatgcaactcgggatgtatgcgtttgagcttgcggtggctcatcttctacactgcttcacgtggagattaccggacggcgtgaaattcggtgacgtggacaccattgaagggccgggtctcacggttgctaaggctaactctcttgtggcagtgccgatcaagcgcctcctctgtcccatggtcttggaaagccacaatgtttaaaaacttgttttcataattattattttacgttgatattttcttgtgtaatgtatgtatggtgttcatgtttacgttagcattattttctttaatataatatccaaataaatacataaagcgtaaaatatggttattttaaaaatatactaacatcaagaagaaaaccatgtttttttcaagactaatatagtcccaatgaacattaaactagcttatgaccattttctgagtagtagatccaatcatatctagcatcccacaagaatcgtgcgccgaattttatgaaataacgagattcttcatgtattatggcaggacataaaatatttcatgttgtgaatgttacgaaactgatttaattaaaaaaaaaaaatttgaagagtgcaataaacatgtttttttatagagtgaaaggaaaatcatttacacgaaggatttttcatccatatgtcataagatcattggacgagaaatctttcgtaaaaatgatttcatttcgttttataaaaaaaacatgcttatttctctttccaaatcctcatcttctctattaaaagagaagtaccatttttatctactatttagaagtctactaggaccatttcattaatcacataatatgatataataattaataagaatattaataataaattaattttaactatagatttgaattttattttcagttataacaaaatctgttgagaaaaatctaacaaaatcctactaaatttttaaataatttttatttaatatttgtttaattaatttcgtaattaaataatataatgctttcatttaaataaattatcatctaccactaaaacgggttcaaattttttaatcatgtcagatttgttttatacaaatgatgttattaacatatgttaaaaatttatttctacagctatatattttcaaaaatcatatgttgaagaatattttttatttgatgatttcaaattatgaaaactcgaaaacgtaataaaaaaggtaaaatgtataaaacaaacccctatattaataaagtaataagaaacttaaacaataaaattaaaaagttataaaatactaaacactaaaatataaattgtatatttaaatttatataataatattaaaattaaatatttataaaatgaaaatatacccgcactatgtgcgggataaactctagtttttaattaaattagttataacattcaacaacatgcaatatgtcacgtcttgccacaatatataatctgcaaatgaaaatataaaatgtgagtataaatttgtttatagttcacacaccatcaaaatatatattccctcctcgaatctttcgtatagtatcataaaagtttaagactcattctatttctccaaaatttgaaaatttcaaacctattaatacacgaaatgcaagtttgaaacatatatacacgttgtcaaagaaaaaaaacatatatacacacgcaaagaagaaatttcgaatgaagacaaaatagtgaagaaaaatagcgttggatgtgttcatcataatatgggattgtgaaatttttattttcatcaatttcaatggagttataagaatgaagccaacaaccgggaatgagaatgcaaaggaggaaaaaaagttttgttttttctgggtaaaaagaaacaaggtcgttttcaaacaaacattccaagcaatttactgaaatatcgaaataattttttttttaaactcttacgctaacaagaaaagtaggtcgttactccagaaatactgaaccgtacttaagaaactgcagcaaacacgaaaactggactcgttaaaagacaaagataaagttaagcaatcgtcattcaagaaacagattaagaatcgaaagaagcattaagattacctcaactcggagaattagatgcagcagctagctagcgatctgaatgtttatcgagagagagagagagatagagatagagtgaatgagaaaggaagggagtaagacgaaacacaagaagaaattctatcgttagtgaaagaaactcaagtttttagcaaaggcattagatatatgggaataagactattggtgaggaatggaacaagaagctgtggtcggttgtataggagtgaggttagatttggtatagtgtgtcaaagtaaaaggcaaatatacgattaatataagtaatcgtgttactatgtcgcaaatcataaaagcatcctcctaagtacgatatgtataaagtacgttaagtatatcgatcgctatataaagccagtctggtagtctacactctatacatatagatagggacatggatgccatgtgccattctgtattgtacattcaactgccattaatttccttgtcccagtcttcttttgaatcaattatcatgccttctcgaattattgtactctgctattgatcaatttatttgtccaaatgtactcttcttttgaattatttacgggtgtcttcttccactactatactactttgttttgttcacctttgaagtgtttggaataaacggttgaacgtgtttagggtga

SEQ ID NO: 76 - DNA, 1575 bp, Solanum melongena
  source 1..1575: /organism="Solanum melongena" /mol_type="unassigned DNA"
atgaaagagatggtgcaaaaaaatatcaattcaattcttgaagctttacaagctaatcctatgctactcttcttgtttattatccctctcttcttcttataccttttctcgacgtctagccggagacgttatcctccaggtccaagagggtggcctctcattggtaacatgatgataatggaccagttaactcaccgtggtcttgctaaactagcagaaaaatatggtggtgttatgcacctcaaaatgggttatatccacaaaattgtaatatctggtccggaggaagctagacaagtactacaggtacaagacaacatatattcgaaccgtcccgcgaccgtagcgataagctacttaacgtacgaccgtgcagacatggcttttgctgactacggaccgttttggcgtcagatgagaaaattgtgcgtcatgaaactcttcagtcgcaaacgagcggagtcatgggactcagttcgcgacgaagtggactcactgatcaagattgttacaaccaacgctggcacctccgtcaacttaggggaacttgtttttggtctcactcgtgacattatctaccgagctgctttcgggactagttcagctgaaggacaagaagaatttattaaaattttgcaagaattttcgaagctatttggcgcgtttaacatggttgattttattccatggctaggatggattggtcagcaaggtctaaatgttaggcttgctaacgcacgggcatctcttgatgggttcattgattcaataattgatgaccatattgaaagaaaaaaggctaatgttactattgataatggtgacagagaaactgatatggtggatgagcttttagctttttacagtgaagaagctacagtaaatgagtctgaagataatttgcagaatgctataaggcttacaagggataatatcaaagctatcatcatggatgtgatgtttggagggacagagacagtagcttctgcaatagaatgggtgatggcagagcttgtgaaaaatccagaggagcttaaaaaggtacaacaagaattagctaacgttgtcggactcaatagaagagttgaagaatctgatcttgaaaaattaacctacttaaaatgttgtttaaaagaaacgctccgtctccaccctccgatccctctcctcctccacgaaaccgcggaggaatcgaccatcttcgggtaccatattccggcagggtcacatgttgtcataaattcatttgccattggacgtgacaaaaattcatgggaagatgctgatagttacaagccttctaggttccttaaacaaggtgtcccagattttaaaggaggtaattttgaatttttaccattcgggtcgggtcggagatcttgccccggtatgcaacttgggctttatgcattagaaatggctgtggcccatcttcttcattgttttacttgggaattacctgatgggatgaaaccaagtgaacttaaaatggatgatacctttgggcttactgctccattggcaaatcgactagtggttgtgcctagtccacgtttattgtgtacactttattga

SEQ ID NO: 77 - DNA, 7670 bp, Solanum melongena
  source 1..7670: /organism="Solanum melongena" /mol_type="unassigned DNA"
ttatttcatcataataatttttaaattttttatccaagctaacataaattaaaatggatggattattaattaatcatgataattgcataaatctttctttatcttgttaaatttatgtccaatcaatagataatcataaattaaaatggcccccttatttaataaacctgccctcatattatcttcaatcgatcaaaaagatttaaggggtcgtttgagaatttacgtggagattagttatattgatactagtcatgttaaaaataattatatcaatattattattattaaaaataatatttatggcataagtttgatttatacaaagatttaagaaattgtttatttataaaaatacttttcgccttgtttagtagaaaaaaaaattcaaagaacctcaaggatatgtatttttgtaagtttgttttatttctgtaaacaactagtttgggatatattcataataaataatcaaataaggaataagacaatacaattttattttgaaaattacttggaatatttatggccaaatgggaccttagatctaggggtgtgcaaaaatcgaactgacggataaatcgaatcgataaaaatattattgatttattgttattgggttattaggttatcggatttttaatagtatttgaaaaaaaacttattggttatcggttcgatatcaatttttactattggataaactgataacccaataagattatataaatttactattttaccccatcaaaaatattaaatattaataatttaatagtaataggacacaataatagtactttacctattttaatctttagactagttacccactttaataattaattatggcttttgtaagttagcaaatgtagccttcatacgtcatttgcttttattgatgcaaattcttatgaaaattcattattgtcgggtaaatcgaaaaccaaattgttaaagatttaaaatcgataaatcaaaaactgataaaaattattttattgatttgttattagttttatatatttaaatactaaaaactaataaatcaaatcaataatatgtaaaatcgaactaaaccgatcgatgcacacccctccttaaatctatcacttcatgagcagagcaattactcgctttaattaatttatggcaaattgcactagcaagtagaagtatacataggtctatttgttttttttttatagaaaaaatcaaatcaattatattgatttgttaaagttataaatcaaatcaatctaatatttatttttcttttatagttataccgtaattaaaaaagagatagaattgaagaggttgttcttttgattgtgtgtgatttaatgcttaatggcatctcaaagacattggaataaataaagtttaaaaaaataaaatgtacaatgacatcttcaagacattgttttagaaaaacatatcaaaaactcacgaaatgacaatatatttaatttttttggtcatattacaagcctaaatatgaaatgatatatgtaaaagttaaaatttatagactagttttaaaaaatacttacaaagcatattataatagtaaataattatgtataaaaaaacttaaattataaatgtattatgtcagtttgatttaaattcgatttgatttatttttttctattgatttattttttcaacaccaaatcaatcaaatcaaaccactaattattatttttttagtcaatttcttgacgatttaatttgtacactctacttgcaagcgatatttaagagaatttatatatgatatcatgaagtacaaattgaaaattatttcttgactatagtttcttgacattatatgtagttgagctaaatatctaacacaatatccaagccaacttggtgatgacattcaaatgaaacttgtatatatagacccccatcattttgtatacactcaaaatattaaatctagcaagtacattcatctcacaaaaaattcaagtacccctcataagataatgaaagaaatcatacaaaataatacttttttcatacttactactaaagaaacaaacctcatgatgccactctacttcattttccctatattcatctttttcttcttcactatatcaagattaaacaagaaaaattttccaccaggtcctaaagggtggcctataataggcaacatgatgatgatggaccaattgacacatcatggcctagcaaaattagcaaaaaaatatggtggtattttacatctccaaatggggtatcttcagatgaccgtggtgtcaagtccagctgaagcccgtgaggtgctacagttgcaagataccatatttgctaatcgtcctacaactatagcggtggaatatttatcatatgctcgtgcggatatggcttttgctaactatggacccttttggcgtcaaatgagaaaattgtgtgtcatgaaactttttagtcgcaaaagggctgaatcttgggactcaattcgtgatgaggttgaatccatgactatggctgttgccactagggttggttcaagtgtcaatattggtgaacttgtctttggagttgcaaagaacattatctataggtaattaacgcggagaatgagcaggttgaattaaatctgagaaagttatggggggtgggggtcaaatcaatgaaagggtcaatgatccaatatgtcaaataacaagtcttaacctaaatccttcgacttgatttgaccttacttgacatgaaccccttcttttttatcttgcttgtttaccaaataaatatgaaagctaatatattttttaaaaattattactttatactcttacatatttacatgattctcgtttttccaagagtttttaattttgtatatatggatatgagattcatttgatctgtctaatcacatcttttttactagttttgattcaaaaattgaataagttattccgaattcaatttattaattcctaaaataagttgattttgtcatctctatctacagggcggcttttggaacatgctcgaataggggacaagatgagttactaaatatcatgcaagaattttcaaagctttttggtgcattcaacttggctgattttataccttggcttggatgggttgatccacaagggttaaataaaatgatcataaaagctagggcatccttagatggtttcattgatacaataattgatgatcatatacaaagaaaaaagactaataattataatgatgaaggaaataataatgatatggtggatgagctcttggcattttatggcgaaaaaacaaaattgaatgactctgatgatttgacgaatgcattgaggctaacaagggataatattaagtccattatcatggtaagttcaaaatcttgatgttcctatttctttatagtttaattatacctatctttggtttcagtatgttgatagtgtaaaagaatttttaatattattaaaatcaactattgataaaaaaaatgagatttataatctaaatcagatattaggtcagttagggagtttaaagtcatgatacatgtttgatagaattcagttactcttaatttgctcaaacaatatatttatgctacaaaatttattattattattattatatatgtatgtatgtatatattaaatttagaatttaatcataattaacaattgaaatcattattctaaccatcagaactcataaaattaaaattttgattcggtagttgccctaaaaattgcaccaataatgtaaaccatacttggcctactgtcacataattgtgagtaggcctactgtcacataattgtgagtaggccatgcattgaaattatactttttaatgtttataatattattgaacgcttattttggagttttattttctttaaaagagagagagagagaaattcaaaatatagattgaaaatataaatatttttaccatgatcaccacaaaattttacctattatacctactatcttatgtatcttaaatcattatatacgaattaaatattcataatatctttcaaatgatttgacagtaaatttaccatgacaggatatcatgtttggtgccacggaaaccgtggcatccgccatagaatgggccatggctgagctaatgaaaagcccagaggatctcaaaatggtacaacaagaactagccaatgttgttggcctccatagaaaagtagaagaaatggattttgaaaaattgatcttcttaaaatgttgtataaaagaaactcttcgtcttcgccctccgatccctctcttagtccatgagtccgttgaagataccacaatcaacaattactatataccagctaagtcgcgtgttattgtgaatgcatgggctattggacgtgacaaaaactcatgggatgatcctgagagttttaaaccttctaggtttttgaaagaaggtgtagctgattttaagggtggtgactttgagtttttaccatttggatcgggtagaagatcttgcccaggtatgttcagacagaactaaaatttaaagtttttgaaaatatatgagttcaaaacttaattacattcatagtgtattccaagaaaaatataatggcacattcttaatataaataattttaactttaaaattttctaatgtttataacaattattgtagtcgtaaactcagtccattcagtttaaaatgagaagtaaagttaaataattcattttaaaaaaatatataaaggcattattctttttttaaacagattaagaaataaagtgtgtcacatgaaatggaataaataaatattatattttaatagctatataagtatcataacatatttaagatataagtttcaaaagtattttcagttttcttgattatattttcattcaaacacccttacataaaataaaaacaggcaggcagagtacatattttagaatatatttagcatatatatttaatattatactaatatatattgaaatatgacaaattcaaaagtgtgttacatgaaatagaataaaggaaatatattttaatagctatataagtatcataacatatttaagaaataagtttcaaaagtatttttcatttttcttgattatatttaaacatcattacataaaataaaacaaacggagtacaaatatattttaaaatataattagcatatatatatatgtttaatataatatataattgaaaaatgacgagttcaaatcaatccttgtggtctaatcctttcctgggataaaactacatgcgataaaattttacaatatgattctttgttgaatctcgatcaatacagaataaaagctttagtatttcgatcttgtagtttaaccctgcccttcgataaaacaataatatacaataaaacttcatgatctaattctttattgactctcaattcatacttagcaagagttttagtgttccgactcgtgagaatttcaagcatgtgtgtttgtgtaggtatgcaaatgggattgtatgcatttgagatgacattggcacatcttcttcattgcttcaattgggaattgccaaatggaatgaaaccaagtgacattgatatgaatgatgtttttggacttactgttcctaaagctacaagacttgtggctgtgccaactccacgtttgttatgtcaactttattaattttgtgaactaataattagttaggaattcttagatattatataaaaatatacaagtatggtcatggaaataaattcttgaatgagttgatcatggaatatagagaaaaatattgtgaagttattggttttctttcatgtattgaacatgcaatatattggcaaaacaaagaaagtggatatcttatattatttaatattattaactgttaatttaaatattatatttgtgttgataaaattttattatgacatattgttatatgtgtctttaggtaatgatgaaaaaatttcaatcttgtgtgacgatcaacttgatgtgattacaaaaaacatgttttttttttaatcttagtttaacttaagtcacatttatttatttgcacttaataaaagtcttgatcttaatcatcaactctaaatttcaaccattcagatctaaatcatgaagtgcatttaattttttttcatgttacgatcacatagtacatttgaataaatttaaatgattaagatatataacaaataacataaatcaatggaacatagtattggcacaaattgcaaatctacgtaaaagtgaaaactcctgtggtagataggtcaaaaaaatgatgaaattttttactatggtcttttttagtccacctcaattattccgacgaatatatgtcgacttggcacatcccaccaacaaagataccaaacgacgtaatagataaaaagaaatctccttatgtaatacacaattctcaaactaacatgttttttggaaagaaacaggaaacagaagttagctgacctacttttcattaaaatttacaaagttgcatattcttgtttcagaatcttacatgctaaagctttacagttggtaaatatgtggtcacaactcacaacaatgagtagtctacaagaaaaagaactgtcaaatctccatttttacagcacgacgaccgaaaacaggataatacgtatccagctcaagtagttctaagatctcttgtgtagcccatagatacgacgaatggccttcgatgaattcagttacatcaacctgtaaatggagtaccaatgaaattgaacttcagttaaataaacaactgcaatacagataaagatgggaatagaacttacattctcaacaccaggaacctcaactggttgaattccagccaagccttgcgtaaggagactgtttagagaagaaattacagaagtcacaagaaagaaaggcagaaaacagcaaatcaaacacgaaagcagatagtgcggaaatccttcaaacagcggcagtacttgacatgttcaacattagtactatgcttgcgggcaatgcatacctggcacgaaaggcaactccaagcatccaatcatttgtagaataagcattcacaaatctacccgctaccatctgcaaaacaagaacagcgagcttcagatagtaatgaggtcgaatcctatacttgtaaggaaaacaaaatatgaacaaaagggcatgcggaataggggaagaccaactataattagaagtacttaaaataaagaaaaacacgagaccgataacctttctagtagcttcccagttcatatccttaattgcaatgggtgccccaagaagaacgaccctttccacaagtccagctgccaatatttaagtacttcaggatcttaaagcaaatctgaatgaccctaaaagaatattaataataataacagtatgcatattatgcattatctttcattaatgaacgtaagcacaatgctttgtcttccactaataatagtaagcatattatgccttatcttccattaatgaaagtaagcaccatgctttatcttccattaataaaagtaggcatattatgcaatatatcattcattaagaaagataatgcaatatatcttgtcttccattaacaaaagataattatgttaagatttcaagtggacgataattttatttggaatttattctccacttgggaatgtttccacttt

SEQ ID NO: 78 - DNA, 7964 bp, Solanum tuberosum
  source 1..7964: /organism="Solanum tuberosum" /mol_type="unassigned DNA"
atgatattgtgtaccctgatttcgatttgtttgttttaattatcattttaagagtaaatgatttctttttcaaatactttctaaatatttgaaattgttaactatatatattttaacttataatagttgttttttaaatataatttttaaataaatgaattttatttttaaaaaattaaattttttataactaatttcacattaaacattaatttatgtgtgagattaggaaatatgtacaagcttgagggagtttttacaagatttgacgtttgcgtgaaagattaaatatacgaaaaagggctaaaaatatccctaaagtacaggaaaaggtctaaaaacacccttcatccatcttttggtctaaaaatacccttttactctctcttttttttcaaatacttattatgtgtcattttcttattgaatgaaataaaaatccacctctattaattttccccccataatttatccaaatcaaaacaatatatcttttcaagatccaaaaaatatattttttaaatctagcaatttctattttctatagctcttttccaaaaaaaaaaattgttttagataattaaaatatttttaaaaatattagtcatgccacaattacaaagacataatatattgatataaatcctaaaaaaaagttgttccaattggtgcaccagtccaagatttgatcactaatgacttggatgacaagattattagtcaaaaaaattaaatgctctttttttttaaaaaaaagaagaagatagaattgtacccgcatataaagttatgtttcttcaaattttatttgtgtaatttatttattttccatatgtttaaaatttgttgcaaacaaattggcatgcctagtgggaccaaatctgcgcttcatatcttctctcttaaatcaaatatgaaaatctaaagctgcaaaggtggaagaatgagttcttcaagcctcgtctttgagtttcatcgattctacactccaacaagccttgaagcaaggggcatttgtagacattgaaattttgcggactctacaagacatgttcaattcgaattgggactctagaaggtgtgttcagtttcaattagaatttttggagtttactcaaccctaaaccctactttatgcctatataaaaagtactaaactcccttaaaggaatcgcaaaatatccataaactcttgggtatttttaaagatcaagatctcgaatattccacaaaagtaatggaatattcatatagaagttaaatctaaatcattctagttcgagaaatacgtcactaacggccctcgaatcatggataaatcttaggagagtagaatcaagagagaaacagaattgtacccgcatatttatcaataaagttatgtttcttcagattttatttgtgtgatttatttattttccatatgtttaaaatttattgcaaacaacaatctctcaaggcctcaattaattcatacattacttcttcaaattttaaatcctcttaataaaatttttgactccacacgccatggtccagttcgccaaacttaggcaaaaaattttggtgaatttggccgttcagctacctgaagtacaagatgctagtgactagttcccctctcatatgattttttatttttggttcccacccggtgtccagagcccacattgaactgcatggctcatttggggggggtgctcccaacaagactttctacatagtcagggctcgaacccgagacttctggttaaggataaaaacacttcaaccagtacaccacaacccatggtggtcctctcatatgaagttgtggactagcttgggtcagtctttgacttaaaagaccaatctacaaatagtttaatataaagcttaatataataatatgtattggtatattttacttgacatataaagcatatttttttcgccaaatcaacagtatacaccaacttggtaccgactggaagtggaataaatttgtatataaagaccccatcctatccaccaataaaaggtagaaccaaaattttgagttcatcccaacaagtccctatctcctacatactccaccaccatctcccaaaatctccactgaaaaacaaaccaaacatatcaaaacaacaaagaaaaaaagagagaattgtaaacaaaatgaaagaaatggtactaaacaatatcaattcaactcttgaagctttacaagctcagcccatgctactcttcttcttcatcatccctctcttcttcttataccttttttcgacgtctcgccggaaacgttatcctccaggaccattaggctggcctctcattggtaacatgatgatgatggaccagttaactcaccgtggtcttgccaaactagcacaaaaatatggtggcgtatttcacctcaaaatgggttatgtccacaaaattgttatatctggtccagaggaagctcgtcaagtactacaggtagtattggaatatctgaccatctcatctaaaaagaatttatacggacggtataaataatttgtcagtagtataacataacatattgtagtactactaattaataagtttgggtatcttattatttttcaaatattaaattaaacagattatttaatttctaacaggtacaagacaacatatattcgaaccgtccaaagaccgtagccataagttacctaacgtacgatcgtgcggacatggcttttgctgactacggacccttttggcgtcagatgagaaaattatgtgttatgaagctattcagtcgtaaacgagctgagtcatgggactcagttcgcgacgaagtggactcaatggtaaagattgttacaaccaacacgggtacatccattaacttaggggaacttgttttctgtctcactcgtaacattatctaccgagcagctttcggaacaagttcagatgaaggacaagatgattttattaaaattttgcaagaattttcgaagctatttggtgcgtttaacatggctgattttattccatggctaaggtggattggtcagcaaggtctaaatgttagacttgctaaggcaagggcatcacttgatggatttattgattcgattattgatgatcatattgaaagaaagaaggctaatgttattaatgatgatggttatagagaaagtgatatggtcgatgagcttttagctttttacagtgaagaaacaaaagtaaatgagtctgaagatttgcagaattctataaggcttactagggataatatcaaagctataatcatggtaagtttttaacctaatgcttttccgtacattttttttgtgtggttgatacatgttccaattaacgtgtcataatttaaatcaactcgtggtttaaaaagaaaaaaaaaactaaatttgtacttgtggcatttgtggttaaaaagaaacatgtcatgtgacaacaatttttttttttttaaacttgtggcatcaaatatatcatttgatcagggaaatgagaagggtaaactttgaagtttgaattgataagagatttaagaaagattcttttttttagaaaaataactagtaatcttaaatatgtcataatatttgtgtgataataacttttttgaaacttatgtcataatatttgtatggttacagaagattcttgttaaggtaaaataggaagtacaaagttgataattttcaaattttaaaagtgacatatttttaattaacaaaaaagaaaattgttttacatcaatcgaaaggaatagtatattgggaaaatacaaacaaataaaagagagtattattttaacataaattaatttgatgttgaaaatcttgcccaaaacaagaaactttaaattttaatcagttgctactaggtaggatcactgaacacggctatctctggcagctcatgtataactatcaagaatagtggaagcttaggaaacactattatttttcgtgaaaatatgtgcaatgtataattttagtactttacttatattttaaaacttcctttgttagatgaaaattttgataattatttaattaagttgactctttatgatttgtttttagaataacaagatgcgttaaagtttctcaatcatcacaaaattgatattaagagtgaaaagaaaaaatattattgaaaattgataacctagtataataaaatttgtgctaccccatatttctatggttttagcatcacctagctagactttaattcaaaaatttgatgaaacttattactaattcaattcattatataggaaaaaatctccctttaatttccaatttttcatacaacttgatcctagtggaatgtcataaaatagaaacattaatttcctctaaatcattagcttcaaatcatttgtttttttgaatgtctcatcaatataataaacaccaaatatgattacgactttatcttgttatatacgatataattgttaatgtcctagctatggtctactatatagttttctagaattaaatagtacaaaggaattagcgtactgtacaactactagatcttataagtagatttttatttatttataggtctctctactgatgacatatatcatgagactaataagttgatttgaactttccctattaatcttgattttagcttcaatgctatccaatattttgccaagtggcacaaatggaagatttattaggtaacaaaagttttcaagtacaattgcctaatgtttttaatgtgaaaaagttactccagaaagaatttactaatgattaaataaaatcatactagccaatgaatatacttaacgtgtaaaaaatgagttagagccgtaaaaactatattctatgattaaaaattcaaactggccaataaatacctatctagaaaatttggtaccattccttatccctttgaaaaatcatttttccgaaaacgatgtacaagttatagtttatcttacttctacctaacccccttacctaactacatacctatttaacttttataagcccaccatatcaaaaaataaaataatattgttatgtattatattacttgactcgtattgatctgacgtggaagagaatcgcaggatgtaatgtttggtgggacagagacagtggcatctgcgatagaatgggcaatggcagagcttatgaaaagtccagaggatcttaaaaaggtacaacaagaattagctaacgttgttggactgaataggaaagttgacgaatccgattttgaaaaattgacctacttaaaatgttgtttaaaagaaactctccgacttcaccctcctatccctctcctcctccacgaaaccgcggaggaatcgacagtctctggctactatattccagcaaaatcacatgttatcataaattcatttgcaattggacgtgacaaaaactcatgggaagatcctgatagtttcaagcctagtaggttccttaaagaaggtgtgccagattttaaaggtggtaattttgaatttttaccatttgggtcgggtcgaaggtcttgccccggtatgcaacttgggctttatgcattagaaatggctgtggcccatttacttcattgttttacttgggaattacctgatgggatgaaaccaagtgagctaaaaatggatgatatatttgggcttactgctccattggctaatcgactagtggctgtgcctactccacgtttattatgtaattattgaaggagaaaaaagggtattttctacgtgtatacgaatagttatacacaaaatattggtttgcttggacatgtttatctttttttgttttgtctattagatgtaataatagatgcatatacataatggagaggacgaaaataattgcttgaaagggaaaagagagaggaattgattatatggtatttgtgtatagtagacactatatatctctttccttttgttttttaatattcatttggcttgcattgttagttgtaaatgtcccctcctcttgtttgtttcttctttgaaaacataattttaatcaaataaagactttatccttgttaccttattgtattataatggttcattttgattggatcagtaaggagaattcaggtaaatagtccgacaaatttactgtttaatttttctgatcgtacatagattacacattaattatacatgattatatacatacacacacaaatttatacacgattacggaggctattgtgttcttttatgagggaaaaaaaaaatgaatttccatatcctgtgacacccaatcgggttgcttctaaccaataccccctttgcttcagaaagcaggaaaaggatatttatccttttgatattcactttttacctgtttagtttagaaaatctagaaatattttattgtttattttttaatttattcttattatattaattaggaaaaatgcataagtactctcaatctatacccaatattccaaagacacacttatactatactaagatcctattactctcgaacttattttataaataattttctacctcttttcggcctacatggcactatcaaccagatagcttgaaaaaattgtcaacacgcgttgggctcagaagatagtgccacgtagaccgaaaatgggtagaaaattatttataaaataagttcgaggggtaataggaccttagtataatataagtgtgtctctgaaatttcgggcatatgttgggggtacttatgcattttccctattcattataatcctctttcaatgcattcttcaaagcattaaatttgttataactaaagggtaaagcatgttctaggttaatattaaacaagtaaaaatgaacgaaatgaataataacaaaaaaaatagacacatgaaaatgaatgaaagaagtaataacaaaataaatctgataatggagggtagggttgagtaggtccaaagctgtggaggggaccgttgagaaggtttgaatttcgacgctgaaaattaaaatagaaggacacgacactagtaaaggaagggaaaatagaggatcgaattcttttgtgaaagttcaaatagttaattaatggagttattaattagatgtttcatgtcattagttttttcttcttaaattagtgtaagacaaaggaaaatagggaatcaaactcttaagtgaaagttcaaataattaattaattgagttactaattagattcttcacgacactattttttattcttcttaaattaaggtaaggaaagagaaaatagaaaatcaaactctttccgtgaaagttcaaataattaattaattgagctactaataattatttttcatggcactaatttttcttcttcttaaattaggtaagggtaggaaaaatggagaatagaactttacatgaaagttcaaatagttaatcaattgagctactaatggatttttcatcgcacaagattttcttcgacagggaaaatagagaaccaaactcttaggtgaaaatttaaatagttaattaattgagatattgattaaatttttcacatctgtttcttgaattagggtaatgaaagagaaaatagagaatcgaaccctcacgtgaaagttcaaatagttaattaattaagctactagttattaaatttttcacggcactaatcattttttttcttcttaaattagggtcagagaagggaaaatagagaattgaacccttataaaagttcaaataataattaattatgctactaattagttttttcacggcactagtggatgcatggttccaaattaaagtaagccaatttttcaactccccaaaaatgtagttgttgtagaaagttgacactaattggaagacgtacgaaagcaaccttaattgagttgaatatgtgatgcattaatcatagggagtttaattacgttggataatcttgaaaagtttaatttagggatattaaatgacaaaatttcttttttgacatataagaata

SEQ ID NO: 79 - DNA, 6217 bp, Malus domestica
  source 1..6217: /organism="Malus domestica" /mol_type="unassigned DNA"
agccaattagggttttacccaaaaattaaaaagaaacccacaaaataaatcaagatttgttttccaaagaagcaccatcataatttgactagtaatttaaggaaccaatatgtaactcacacatatatatatgattcaataaaaatataagagactaaaaagagtgcccaactgataactaaaacttgatttacatgatatttttttaggaaacaaatcaacaatcgcatgagattcgatcaatttggtgaatatatttatatttgggtggagaggaccaatatgcctcacatgtatgtgactagttcgacgaaagtccacaatggcagcagctcttcttgttgccttccagccatggttgaactttagaaccattaatttatttttctcaggaaaacattaataaaaaaatgtcaacacatattatccaagattcgtctgtaagttattttgtctaaattgcaagagctgaactcatttcttgtaagtttagttttatttattagtccttttattgaaggaatttcagataatcaattccatttgctgtacgaaatctctgttaattaacttaattacatgtatatctctttcgtgttaatcagtttaagatgtacttaggtttccaagacatataaattatttcaaggcgccacataaggtatatcttataaccaaaccatgttttcttgtaatcatgtatatgcataataatattttattttgacaacatgatatgatgtctataacgtaaaagttaatattgttataacaataatgatgtcattatgtgttatgtaactaaaatcttactattattgtgtaaccttagactataaatcttaacgattatggtgtaattaaccttatatttcttgtagtccagacgttgaatgttaacattattttataacaccaaatgtgaaggtaaagagtcaaaagtgaatactgataaatgtgagatttcttgacgtctatttttaataacttgcgtctataaacgctatactataacaagacattcataaccatcaaacattagtgtaacaatatcattccataacctcgatcactatttatgtaacgttgaatagtaaatgacaattataatataattgttgttatacaaatggtggcgtagaaatttgctttattaatttgggacttatttgtaaaaatatcagttgttttacttcagacaaagtcaaattgaagcaattttgtgacgttgttcctatgagtagactctatcgttcctatgaggagactctacgaactctctcatttcttgtttgttttaggtggagcgtcttactattaactaattaatactcccagtccacacttcatatatttataatcaaattcytacgtctctactatgattggatgaaagaaataaacttagaatttagataaaaatcagaatttataaattgatatacaccaattcgcttgtttgaatttataaacatagaaatttagaatttcagcgtgaaagaaaaacttggaatttaggacctccaattcccaagtttaaattccatgtaaataggtatcatttctcaatttctatgattgagagtttaaaattaacaaagttcattctcaattyyattgttcttttaggttaatcaaataagaaaattcataaattttagaaaataaaatctcgtcattttaaaatttcttaataactttaaatttctccattcaaacatagtataaacgtcgaaacggctcgaatttggataatgagaaaaaaaagggattcaatccaaaaatccccaaacttggtttcttgtcccatactatttcttttcttttccaactttcataccataaaaatactataaacaaaactaaacaatctcaattgtttttaaatagtttatttctcgatagcctgaccaaattccactgtagcactaaaaaaataaataaataatccaacagttgcacaaactttgtatataaaaggcaccataatatctcttccaacttagcaacatttggaggttgccctgctacttctgctaatcatacccacgaaaaaaggtaaaaacaaaaaacaaaagaaacacacacaatatggattatcttctgcagtccttgcaacccttacaatccatgacaccactcttgctcataatcccactcctatttctcctccctctaattttccgtttccggcgaccaccaccatacccgcccggccccaaaggcctaccccttattggcaacatgttattgatggaccaactaactcaccggggcctcgccaagctggccaagaaatacggcggcatattccacctccgcatggggttttttacacatggttgcgatttccaaccctgacgtggcacgacaagtccttcaagtccaagacaacatcttctccaaccgcccggccaccatcgccatcagctacctcacctacgaccgcgctgacatggccttcgcgcactacgggcccttctggcgccagatgcgtaagctctgcgtcatgaagctctttagtcgcaaacgcgccgagtcctgggagtctgtcagggatgaagtggactcatcggttaggaccgtcacagttcatgttggttcggctgtaaacatcggagagttggttttttcgctcacgaaaaatattatttatcgggcggcgttcgggacgagctctcaggaagggcaggatgagtttattgggatactgcaggaattttccaaattgtttggagcttttaatattgctgattttattcctagcctggggtgggttgatcctcaggggctaaacaatagactcgctaaggctcgtgagtccttggatcggttcattgacaccatcatagatgatcacatggagaagaaaaggaatggtaagggagtgagtgacggtgaaacggacatggtggatgagttgttggctttttacagtgaagaagctaaagtatatgaatctgaagataatttgcaaaacgccatcaaacttactagggataacatcaaggccatcatcatggtaaataactattacacaatttcatatcacatatttatattataaccccacaggttgaatgtctatgtaacctgttttcttggactaaacttttggctaattttttctttttatctgatcagatatattaattgcgtattgagacaatgaagatagaaagtctaacatattatattattttgaaactgattgtttaaattgacgatctgactaggtatataacatgctgtatatgcaaattaataagctaattatatatgctacgtactttcaggacgtaatgtttggcgggacggrgactgtggcgtcggcaatagagtgggccatgtcggagctgatgaagagcccggaggacctaaagagggtccaacaagaacttgctgacgtggtgggtctagaccgtcgacctgaagagaccgacttcgagaagttgacatacctaaaatgtgccctaaaagagacactacgactccacccaccaattccactactcctccacgagacctcggaggacgctgtagtagccggctaccgcattcccaaaagatcgcgtgtgatgatcaacgcgtgggccattggacgtgacaaggactcgtgggaggacgccgagtccttcaagccctcgaggtttttgaaagaaggtgtgcctgactttaaggggagtaacttcgagttcattccgttcgggtccggtcggaggtcgtgcccgggcatgcaactagggttgtacgcgctggagatggcggtggcacacttgcttcattgttttacgtgggagttgcctgatggtatgaaacctagtgagctcgacatgaacgacgtgtttggactcaccgctccgagagcgagtcgactcatcgccgtaccgagtaaaagggtggtttgtccactctgatggtgatgaaaaaacagagagagaaacagtggtggaatttgtttggagtgtaatgatactgtgaaaactgcacaggtaaattgcaagcgttttcttattgttcttttgaaaaacaaaataattacaaagagaacatgaacagttgtgagggaatttttwattcactctctttgtgtatatagacactctcttttgttttgtttaatatgtatgcaaatttatcgttaatttcctkkttttttcctttttgttttkttattattgtattgaaataaaaatataatggctgagttacaaaaattatttgtcatggtggaaaaattgatggactgcttatgttacgatttcaatttgttttctgggtcggtggcgcaatagtagaattattttgtttaaaaatgaatgaataaagattaaataaaattagctcttgaacaacggtagaataatgttaaatcatgcttacgatagaagtagctcacgctgtcctcagcagttgtgaaaattgacatttaagttgactgttgcatgtcacttatatatttatttgtggttaaaattgttacataaaaaatatgaagagtaatgctgtggaggttaaatttatagactaaaattgcaaactaaattatgtgtcactaataagaaattagcacttttatcaacgtttaagtaataattcaatcatcaatatccatatcatttaatttacaaaacttagtctacaaatttaatctccctagcattactcaaaagtgaatgattgtgaaaatgaattaaggttggtaggactttgacatataaatctaaatataattaagaaggctctagggtagtgctgttcacacaccttttttwacttctctcactcttattaattttgtttattgatcttcttcaattaattcaatccggcgaccgaaaattgaaaatagtatgtgagaagtaaaaattagtgtgtaagtagcactacccgtggctctatatatggtgcccaagtcaggttgatgcattttggtggctccatatttttgcaagacaagtgccctagctagtgacccgaagagatcttgtttatgaactagttgtatacaactgtttgttatctctcatcatgttaaaaagttaattaatatatagacaaaattatctgtaacatactagtaattaagaaagtttgtaaccaattgtgtataattatgtatctaccttaaatgtggtataagaccagaagaagtaccgtatatcatataacatacttgatggtgcattccaaccgatttatgtgtggaggaagtgtcgtaaatgccttgttgagctgcatcagcatctgtttgtgtgcgcgcgcgcgcgtgagagagagagagagagagagagagagagagagagagagagagagagagagagagagagagagagagagagagagagaatgaatatattgagtttaggtgggcagtgaaaagtgaagtgaggaggacgtgaggccttttccttgtactatgaagaggtaagtggaggagcatgccggagaaatcgagaaggggaagttgagcagagtttggtaggagaaggattgcaagaagaaattaattttgatagaaaagagattaatgttaatagaaaagaaaataatttaataaaaattatagtatttttttatttgtaatctaatactacatcaaatgcttcactaagtcaatctaattaagtctagtccttgaagctaattcagtccgaaacagtccggtgcaacaaatgccctctatgtgtatcaatgatcatgaatcaaaataatatgtataaaaaaatatataaatatgttgtgatttagggacacgtttgtgacacattttgacacacatttttatggaactcactctgtaatgtattttagggatccagccgtctatcttttatgtcttaattttttttatgtcttatcttaaagataatgtctaccaaaaaccacctaaatttgaaaccatatgattgttgattgaatttagtgtttcattgtagaacaatattcgtttattttcttccctacaaataaatgtcttaatagtcttggatttgcataattttttataagaatgatttataaatgatataataaaatatagacaattctgatcgtcgaaatacatataaattagactctacgtactataaaaatagatgtcaaaatatatgccttcgtgtattgtaactctctacatatgtgtgtgtgaaagcagattgtgtttatgtaagtaagagagagctggaaagggacgccatccgatattttccatcct

SEQ ID NO: 80 - DNA, 6188 bp, Malus domestica
  source 1..6188: /organism="Malus domestica" /mol_type="unassigned DNA"
aacctacaaaataaatcaatcaagatttgttttccaaataagcactatcttattttgagtcataattttggtagcataataaacaatatattgaaagtataatataatttatattttaagatataatataattttattaatacgtacagcttagaaattagtttataaatattcaattgctttactttagacaaagtcaaattgaagcaattttctggggtaatgttaggattctttataaattaaattttgtaaactaaatgagatggttgttaatgattaaattattatttaagtattgattaccatacttatttcttattgatgacacttcatttaatttaaaattttagtctccctatcattatctgaatggtcgtttttgttagtaaatgcaaccaactctcttatttcttcgagtttagaatatttgtattttttacgtattaatcaatagtactattctcattacatttttcataccagattttgtaaacctctctaataaagtgagactcacatgtgttgatgggttaatacttctactaaaaaagtaatgttaggagaccaaattttttaaactgaattgcaaatcaaatgacgtgtcaccaataaaaaataaacatgttaatcgacacttaattaataatccaatcatttacaaccacatcatttaatttgcaaatttggtttaaaaaaattggtttctccaatggtggcttataacctaaatttcccctyccccccccccaccccaaaatccactccaacccaaaacataaaccagacctaaaacctaaaacttaaaatgaaggtaaatataggtcacaaatttagcctacaaaagccgctgagacccacggatgagagtgaaaagtgagcattgtcctgtagccaactgctacttttcttcatcgggtggtggtggtaattggaccgttggttaatccaacggtccacattcaattttttttatatttatatatttattgaatccaacggcttaaatcgaatataatcaaatctaacagtaaaagaaaagatctaacggtccaaatttaaatccaatggctagaataatcttaaaatttatcggaatttaaatatttttttccaacggctagaataatttttttttttttaagtttatgtggtttatcatgattttcatgtattgatttagtgatttttcaaaatttatcggaatttaaatatttttaggttaaaatgttcataaaattaatttaggatagtctacataatttttaaaaaaaaaaatagccttaattcattttttgataatctagggctaaaattttaggccaaaagggttagagtagaaaagctgtttctgggctaaaacctaaattttctgggctaaatatttttaggttttaggtcaggattggagatgatctaacattactcctactaaaaatatggtacaaatatagtatgaaaaatgctataagtgtagtatgacttggtatttataccaacaggaccatctctgaatcctttggtgaggatcttgaggatcattgaatcgtgtctgtttatcgtacatcgtgcagttaatttttgtcaagtactgtttgtgtttaattttaaatgaaaatatttaaaataatttctgaccgcatgatgtacgataaacagacaagatcgacggatccttgggatcctcacaaaaagaatctcgcgaggatccggattcgtatttatatgccaaagcggactcggacctttggataatgatcagggaaaatgacaattcaaaaaatgggtaaacttcttatctcatccatagcactattactttttctttacagacaaaatactctaactttcaaaccatacaattttaaaaacaaaaaagagaaaactccttgaattagttcaattcaagatagcatgacccaatgaaacagcaacaccaaaaaattaaaaatatataaatcaaacagtagcacaaattttgcatataaaaggcaccacaatatctcttccaacttagcaacattttgagttgcccttaaaatccacacactatggattctcttctgcaatccttgcaacccttaaaatccatgacaccactcgtgttcataatcccactcctattcctcctccctctaattttctgtttccggcgacgaccaccgtacccgccgggccccaaaggcctacccctctttggcaacatgttaatgatggaccaactaacccaccggggcctcgccaagctggccaagcaatacggcggcatattccacctccgcatggggtttttacacatggttgccatttccaaccctgacgtggcacgacaagtcctccaagtccaagacaacatcttctccaaccgcccggccaccatcgccatcagctacctcacctacgaccgcgcagacatggccttcgcgcactacgggcccttctggcgccagatgcgtaagctctgcgtcatgaagatttttagtcgcaaacgcgccgagtcgtgggartctgttagggacgaagtggacacggcggttaggaccgtcacagttcatgttggttcggctgtaaacatcggagagttggttttttcgctcacgaaaaatattatttatcgggcggcgttcggtacgagctcgcaggaggggcaggatgagtttattgggatactgcaggaattctccaagttgtttggagcttttaatattgctgattttattcccagcctagggtgggttgatcctcaggggctaaacaatagactcgctaaggctcgtgagtcgttggatcggtttattgacaccatcatagacgatcacatggagaagaagaagaagaacaataagggattgaatgatggtgagacggacatggtggatgatttgttggctttttatagtgaagaagctaaagtaaatgaatctgaagataatttgcaaaacgccatcaaacttactagggataacatcaaggccatcatcatggtatataactattacacatttttatatcagatattataaccccgcattcaggttgcatgtctctgtaacctgtattcttgaactaaacttttggttaatttattctttttatctgatcagatataataaattgtgttgattgagattatgaagatagaaagtctaacatatttaactttaaaaattaataatagttgaggttgacgatctgactacataacatgttgtatatgcaaattagtaagctaattgtatatgttatgtacatgcaggacgtaatgtttggcgggacggagactgtggcgtcggcaatagagtgggccatgtcggagctgatgaagaacccggaggatctaaagagggtccaacaagaacttttaaatgtggtgggtctagaccgtcgacctgaagaggccgacttcgagaagttgacttacctaaaatgtgccctgaaagagacactgcgactccacccgccaattcctctactcctccacgagacctcggaggacgctgtagtagctggctaccacattcccaaaaaatcgcgcgtgatgattaacgcgtgggccattgggcgtgacaaggactcgtgggaagaccctgaatccttcaagccctctaggtttctgaaagaaggtgtgcctgactttaaggggagtaatttcgagttcattccgttcgggtccggtcggaggtcgtgcccgggaatgcagctagggttgtacgctctggagatggcggtggcacacatgcttcattgttttacatgggagttgcctgatgggatgaaacctagtgagcttgacatgaacgacgtgtttggactcaccgctccgagagcgagtcgactcgtcgccgtaccgagtaaaagggtggtttgtccactctgatggcgatgaaaaaacagagttggattgaggagaaagaaacagtgtgcaacatgtttggagtgcaatgtcaaagtatacatacagtaaaaacggcaggtaaattgcacttgtttttaattgttcttttgaaaaacaaaataattacaaagagactttaaaaagtttgtgggactttttatttctctctctttgtgtatatagacagtctcttgttttgtttaatatgtaagcaaatttatctttaatttccttttttttttgttttgttattattgtattgaaataaaattagtggatgagttgcaaaattatttgtcatggtgtaagaccatctccaacctttggattaaaacctaaaatttttagtccagaaaatttagagtttaactgagaaacaacttttttgctcaaacccttgtagattaaagttttagtcccagattattaaataatgaatataggctcttttttttaaagttactttaaaaaaaaaattatgtagactatcctaatctaattttatgaacattttaacctaaaaatatttkgattccgacaaatattaaaaaatcactaaccgacaccatgaaacttgtgaaagaattttttttaattactttagccgttagctttatatttggaccattcgaatttttttattcttttaccattggatttcattaaattagatcttaaccgtttaattcaataaatttataaatataaaactaaaaaaawwatacatatatagtgagccagtctttctaactcatggggaatcttgagctaaatttagcccataaatgagttttgagttttaactcatatttgccctaagaccatctccaatggtggcttataacctaaattttccccttccccccccccaaatccactccaacccaaaacctaaaccaaacctaaaacctaaaacttaaaatgaaggtaaatataggtcacaaatttagcccacaaaagctgctgggacccacggatgagagtgaaaagtgggccttgtcctgtagccaacggctacttttcttcatcgggtggtggtggtaattggaccgttggttaatccaacaatccacattcaattatttttttgttttatatttatatatttattgaatccaacggcttaaatagaatataatcaaatccggtaaaaaaaaaagatctaacggtccaaatttaaatccaatggccagaataatcttaaaatttatcggaatttaaatatttttttccaacggctagaataattttttttttttaagtttatgtggtttatcatgattttcatgtattgatttagtaatttttcaaaatttatcggaatttaaatatttttaagatagtctacataattttttttttaaagttaatttaaaaaaattagccttaattcattttttgataatctggggctaaaattttaggccaaaagggttggagtagaaaagctgtttctgggctaaaacttaaattttatgggctaaatatttttaggttttaggtcaggattggagatggtctaagagttggagcaagttggggtaaatttgtaacttaaaatttgagctttactccaagggagtaggtctaataattgatggactgcttatgttacgatttcaatttgttttttttttttttttttttgtggtcggtaggaatggtagatttatgtacagctgtgcttacgatataagtagctcatactgtcctcagcagctctgaaaacagacactaattgactcatttcgattatacttatatagtggttgaatttcttatattaaagatgtgatattgtgaggatggtgagaatgaatgaatgttggtgaggacgttgacatataaagctaaatataatttagaaggctgtatatatggtgcccaagtcagatcaatgtcttttggtggctccatatttgcaagaaaagtgcgccttttgtaaatactatttatttgttatataagcgtgtccttgctagcgacccgaagagatcttgtttacgactagctgtgtacaactatgcgttatcttatacatttatacaactgtgcacacgtatagaattgtccatatataattagtaaaagaatttcttgtttgtaaaattagttttgtacaactatatgtgatctgtgtakatgatcagaagaagtactgcaaagcatatatataggacagtgcactagttaacctacgcgtgcaggaaatgttgcagtgactgcccttgttgagttgcatcagcatgtgtgtactttgtacaaccgagagagagagagagagagagagaga

SEQ ID NO: 81 - DNA, 5918 bp, Malus domestica
  source 1..5918: /organism="Malus domestica" /mol_type="unassigned DNA"
acatctcaaagcccaaccccaagggtgagcccaaatttagtctccaggcctattactctaatcaatttctataaaraacaaagccttgtaaagtaataaaatcttttgggaatgaccaatgtgggacaaagaaatttctactcaaactactcaaatttccaacaataccccacatttgagttgaaatttcattcaaactycawcaattaccccacatttgaatgcaaatggatgactaggctgcytawamctgagagwgaatagacatratatgcatcgagtgaagtgtcttttggacttgaacttacacagatcatgtctgycayacgtaaattcatacgmttgtgttcattttggccctgaacagatcccggatttcgtaggagctttagagaatttagccatgtcatttctcataaatgtgggccctaaaccccaaggcccatcttttgacaataaatatatattaattaccaattaattagtataccccaaagtccaaccccaagggtgagcctaattttaatctccaggcctattactcaaatcactttttataaaagacaaagccttataaagtrataaaatcttttgggaatggccaatgtgggacaaagaaatttctactcaaactactcaaatttccaatagacagagaatcagtttgttgaggttgtttagcccccttttcttcacttaacgacacactagacaatccaccacttgcctgtttatccccattgaattaccgaaaataaaaataaaaggtcagagtttcacttacatagcaaattaatacatatattcaagtggcctggggacaatgtggacaagggatatattcaagtcgtcatcttctatgcccaaccattgcgccttcgtaagttggtgcataaaggatacacttgttcagcatagctttcattgactgatctgagaactcgtgtcggaaaattttgacatttaggggtacaaggtatgatcacagaaaactagagttctcccagtggcgagagaaactctgcaatccatcataagtgaagtagtctatctctctcatcatgtgtcaccaggggctcaaagtaagggcgactgggatttatcagtaaccatgcattgatacaatatcattattcctcttttgcctctcaaatatagcaaaagggaagcaaaacaaggtcaactgtgaatcaacattttcttgctccattcagtttactaatcgttcgttctaacatcaaattgccatgaccatagcagctaaaaccctgtaacagatctagcatcacactgccgtaaaaagaatagtgatctctgagtttctgtatctcatcgataacaaaatacctacaatcgtatgtgtcaaatatttattttattaatatattcggtcccatagttcttgggagcagcctctccataaatgggggtaaggctatccgacattcacctctcccagaccctgcgtaaagcgggagccttgtgcactggatacgacctattcggtcccatagttacattaattattaaaaaataattaaaaatcaattttaatcctattggttgtcaatgagactcatgaattaaacaattaaattaaaggcatttgactccatctttatttgcggtaaaaaatgtcatatatgacatctcctttagagaataccgtgatgtcttttaatcttagttgacgtatttgacatctcttttacatggtaagaattcaaattattcttcccttcttttgtcgaaattcaattaattccttaattaactggggtataatctgtttccagacaagtggatccaaaattcccactggcagtatacacaaaacaactcgtgacgtttgcaagataaaatacatagcagatatcaccaccaagtcaccagttattacttgccactttagggctgcagatcccttattaattatataaagaactctcatagttttatatgaacctcaccaaccccattttcccaacacaaccaaagccatggaactccttcaccaagctcttcaatccttgcaatcttcacccatgttgcttattcttcttcttcttctcctcatcatttcctttatttttctgtttaattcgcgccggaaacccccatatccgccaggtccaaaagggtggcccatcatcggtaacatgctcatgacggaccaacttacccaccgtggcctggcccatttggccaagcaatatggcggtctcctccatctccagatgggggtcatacatgttatggccgtatcaactcctgatatggcacgcgaaatcctccaatcccaagacagcttatttgccaaccggccagccaatgttgccatatcttacttgacctatgatcgggcagacatggcctttgccaactacggcccgttctggcgtcgcatgcgcaaaatttgcgtcataaatctatttagccgaaaacgggctgagtcatgggcttcggtgcgcgaggaagtcgatgagatggtccaaaccgtggcggggaaaaccggctcgccggtgaatatcgggcagttggttttcgctctaactaggaacataacatatcgggcggcttttgggtcaagctcacatgaagggcaaggcgaatttgtgcagattttgcaagaattttcaaagctttttggagcttttaacatgcaggattttctaccttggttgggttgggttcatgcacagggttttcaggacagaatggctagggcacgtaaatcactagacgttttcatcgacaagatcatcgacgaccacatggctaagaggaaagcaaacatggagaaggatgacagtgaggctgctgatacagatatggtggacgaattgatagcttactttagtgatgatgctggaaaggaaggtgacgaccccaattctggcttcaagctcaccagagacaatatcaaagcacttattatggtatgtaaatttgacaattaatattttcttaatacgttatatttgttggtgaatagtcacacatcagagaaaaacaaaaataatatataatttttatatttgggacataaacttctaatatcatcgagattttccaatgataaaattcaacacatagcaataagtggtatgcactttattaatttttaagaaacaaatctgattttaagtatttgttgttaactattttggtaaggaattaggagagaaaactattctgataaggaattcatgtacgtaactattactatatttatcatttccgattgatatcgattgatttagtactaaataatacgattatcccatatatacgtaggatgtgatgtttggtggaacagaaacggttgcatcagtgatcgaatggacaatggcagagctgatgaagagcccagaagatctcaaaagagtacaacaagagctcaccgatgtggttggattgaaccgtaggctccaggaaaccgacctcgaaaacctaacctacctcaaatgcgcagtcaaagaatccctccgtctccacccgccaatccctctcctcctacacgagaccgtggaagacacctctgtggctggctactcgttcccagctgggtcacgggtttggatcaatgcgtgggctattgctcgtgacccgactgcatgggacgagccagaaacattcaaaccctcgaggtttctggaagatagctcgcctgatttcaaagggagcaacttcgagtttattccttttgggtctggtcggaggtcgtgcccgggaatggcgttggggctgtatgggttggagatggctgtggctcatctgcttcattgttttgcatgggagttgccgggtgggatgaagcctagtgagcttgacatgaatgatgtgtttggactgactgcaccaaaagcggttcagcttgttgctgtgccaacttacaggttgaattgccccctttgaattaatagtttcaagtagacgaggagacgatgatgatgaaatattacttggttttaaatcagtgatcgatgagtcaatttctctacgtaaaggtaccttaactaataagggtttgttatgttcttggtctctctttactaattggataatactattgctttcccccatgggggatgagcttattattcctctattgcaaataacaatatcttcaacatagaaatttcataatcggaacagtccaatatcttaatcttcatttgaagatcatccttacaaaaaataatttgattttgtgatcggttcgtcatccaaatgtatcagtaaatcaacggttcatcatgaatatgctacttgatacctacacttatgatttatttgatacatttgaatggctaaacaatcacgtcaaattatttttttggagggatgatcttaaaatgaagattaagatattgaatggttctaattataaaaaaatctacgttaaagatatgttatttgcaactggagaaatgacctcatctcccatggagagtatgtaagcagtatccattattgtaataatcatttttaattttgtgatcgatataatatcactatgttgttaatagttaacataaatatatgcgtagttgtttgttaacctttgttggctttctgtcctttgtggctcggccgtgtatcttttagtcagttttccgaaagacaaaaagggaagagatcctatccggatctctcccaccaaattctagggattcgaagatccggactcttaaaattgaattcaatggccacaaacagaggatctctctaaaagttataataattacaatagttggatcaaatttcaaaggtttggatcttcggatccctaggacttggtaggagagatccggaagggatctcttccctacaaaacaagtggggatgtacttttaatgttggactgttaaagtcctggaaaaacatcttttgtcaaactatatagcaaaaatagtagtaagctaagatgcttatggtgttagattatggatcgaggttattgatcaagatgaatctttcctaaatttataccaaatttataatctcacaacataatttgatgaactcgatatgcaatattgatcacacaaagagttcatatagaatattggtttatatcataaaaaattaaatttgtagggttcgtaaactgttctattaggtagtagtaacatattaacttgatattgtgatgatacaaggctaaaattaatagtattgttatcaactaactattgatctagtaattttttttcttccctaatgttgaaataaacgtcttgagctcgattcctctcttttatacaaaagataatataaacagtagcatagatttcaacaaatggccgttgaaataaacattttgagttcggttcctcccttctacacgaaagctaatataaatcaatagcatagctttcaacaaatgaccgttgcatttagatgaaagcccttaaagtttgccgaccctttgacatgtggataagtaaataatagaactaggtaattgaagtggttgagaaatggacattgtgagattggaatgcgttagcaattgcgcaatgcaaactatgctgtcggtagaaggtgaaaggataaacctcagccaatgacattctatgcagctgtttagctatagctttttgaacctgtacaaacgatttttattttctttttaatatttaaaccaagaaatataaattttgagtccaacttcaaggtagatgatcgattactcatcaaataaacttatttattccaatcatctttaaaataagaggaaaaagaaataagcaaagttccgttgttgagcaagaaatgaaaaattcatagaaaggtataatctccaccacgtaatgtgcacctacacgccttcattgacgtcgtttctcaattggatagataaaagttttcttcaagtctaaaccccctttcatcaagtggtgaattgacac

SEQ ID NO: 82 - DNA, 6115 bp, Pyrus x bretschneideri
  source 1..6115: /organism="Pyrus x bretschneideri" /mol_type="unassigned DNA"
gctcttcttgttgccttccagccatggttgaactttagaaccattaatttatttttctcaggaaaacattaataaaaaatgtcaacaaatattatccaagattcgtctgtaagttattttgtctaaattgcaagagctgaactcatttcttgtaagtttagttttgttcattagtccttttattgaaggagtttcagataatcaattccatttgctgtacgaaaactctgttaattaacttaattacatgtatctctctttcgtgttaatctgtttgagatgtacttaggtttccaagacatataaattatttcaaggccccacataagatatatcttttaaccaaaccatgttttcttgtaatcatgtatatgcataataatattttatcttgacaacatgatatgacgtctataacgtaaaaattaatattgttataacaataataatgtcattatgtgttatttaactaaaatcttaccgttattatgtaatcttagactataaatcttgacgattacgctgtaattaatcttacatttcttgtagttcagacgttgaatgttaacattattttataggggcttttagatccaggtccaaaaatgtagagtgtttttaggagtgagtccaattatctaattatatgtttttatttcttttatactcattttatattttctaaaaatattaaaaatcaattaaaatcttctaatattatgcattttccaactccaaaagaatatatttaatatcttataacaaaaaaaactaatatactaaaataaatttatctgcaaaacattctaccctaactcaagtaacaaatatatgaatgtatataatatacctatacgtgagatatgaaacctaattagagggtaaaaaaaaaataacatacctacaagtaagacacattaatctgtgacaggttgattataaaaaaagaatctgtcatataggtagataaacataattaacctgtgatataggtcgattataaaaattaaaaataaaatctataaatggggtttaaagtaggaggaagaacgagaaataacaaaaagataaataaaaagaaataagcaaagagataattgggaagaaatttgatttttataataaattttatcattgaacaaataactattgataattaaataattaaatataacaaattggacttattttaataaactggactattcctactattggctcaaaaaattggacttatatcaagtttcccctatttttttttataacaccaaatgtgaaggtaaagacccaaaagtgaatactgatgaatgtgaaatttcataacgtctatttttaataaattgcgtctatagacgctatactataacaagacattcataaccatcaaacattagtgtaacaatatcattccataacctcgatcactatttatgtaacgtttaatagtaaatgacaattacaatataattgttgttatacgaatgatagcgtagaaatttgctttattaatttgggacttagttgtaaaaatatcagttgttttatttcagacaaagtcaaattgaagcaattttgtaacgtggttcctatgagtagactcaaccaactctctcatttttgtttgttttaggtggcttcttaaaactaactaattaatactcccatgtccacacttcatatatttataatcaaattcctacgtctctaaacgtcaaaacggctcgaatttggataatgagaaaaaaaaggattcaatccaaaaatccgcaaaacttggtttcttgtcccatactatttcttttcttttccaactttcattaccataaaaatactataaacaaaactaaacaatctcaattgtttttaaatagtttattactggatagccgaccaaattccactgtagcactaaataaataaataaataatccaacagttgcacaaacttcgtatataaaaggccctactacttctgctaatcatacccacgaaaaaagaaaacaaaaaaaaacaaaaaaacaaaaaaacaaaaaaaacaaaagaaacacacacaatatggattctcttctgcaatccttgcaagccttacaatccatgacaccactcttgctcataatcccactcctatttctcctccctctaattttccgtttccggcgaccaccaccatacccacccggccccaaaggcctaccccttattggaaacatgttattgatggaccaactaactcaccggggcctcgccaagctggccaagaaatacggcggcatattccacctccgcatggggtttttacacatggttgcgatttccaaccctgacgtggcacgacaagtccttcaagtccaagacaacatcttctccaaccgcccggccaccatcgccatcagctacctcacctacgaccgcgctgacatggccttcgcgcactacgggcccttctggcgccagatgcgtaagctctgcgtcatgaagctctttagtcgcaaacgcgccgagtcctgggagtctgtcagggacgaagtggactcggcggttaggaccgtcacagttcatgttggttcggctgtaaacataggagagttggttttttcgctcacgaaaaatattatttatcgggcggcgttcgggacgagctctcaggaaggacaggatgagtttattgggatactgcaggaattttccaaattgtttggagcttttaatattgctgattttattcctagcctggggtgggttgatcctcaggggctaaacaatagactcgctaaggctcgtgagtccttggatcggttcattgacaccatcatagatgatcacatggagaagaagaggaatggtaagggagtgagtgacagtgaaacggacatggtggatgagttgttggctttttacagtgaagaagctaaagtaaatgaatctgaagataatttgcaaagcgccataaaacttactagggataacatcaaggccatcatcatggtaaataactattacacaatttcatatcacatatttatattataaccccacaggttgcatgtttatgtaacctgttttcttggactaaacttttggctaattttttctttttatctgatcagatatattaattgcgtatcgagactatgaagatagaaagtatatattatattattttgaaaactgattgtttaaattgacgatctgactaggtatacaacatgctgtatatgcaaattaataagctaattatatatgctacgtactttcaggacgtaatgtttggcgggacggagactgtggcgtcggcaatagagtgggccatgtcggagctgatgaagagcccggaggacctaaagagggtccaacaagaacttgctgacgtggtgggtctagaccgtcgacctgaagagaccgacttcgagaagttgacatacctaaaatgtgccctaaaagagacactacgactccacccaccaattccactactcctccacgagacctcggaggacgctgtagtagccggctaccgcattcccaaaagatcgcgtgtgatgatcaacgcgtgggccattggacgtgacaaggactcgtgggaggacgccgagtccttcaagccctcgaggtttttgaaagaaggtgtgcctgactttaaggggagtaacttcgagttcattccgttcgggtccggtcggaggtcgtgcccgggcatgcaactagggttgtacgcgctggagatggcggtggcacacttgcttcattgttttacgtgggagttgcctgatggtatgaaacctagtgagctggacatgaacgacgtgtttggactcaccgctccgagagcgagtcgactcatcgccgtaccgagtaaaagggtggtttgtccactctgatggtgatgaaaaaacagcgttcgacgaggagagataaacagtggtgcaatttgtttggagtgtaatgatactgtgaaaactgcacaggtaaattgcaagcgtttttttattgttcttttgcaaaacaaaataattacaaagagatcatgaacagttgtgggggaattttgaattctctctctttgtgtatatacactctcttttgttttgtttaacatgtatgcaaatttatctttaatttcctctcttttttcctttttgttttgttttgttattattgtattgaaataaaaatagaatggctgagttacaaaaattatttgtcatggtggaataattgatggactgcttatgttacgatttcaatttgttttctgggtcggtggcaatagtagaattattttgtttaaaaatgattgaagaaagattaagtaaaattagctcttgaacaacggtagaataatgttaaatcatgcttacgacagaagtagctcacactgtcctcagcagttgtgacaattgacacttaatttgactgatgcatgtcaattatatatttattttgtggttaaaattgttacataaaaaataagaaggataaggttaaggagattaaatttatagactaaaattgtaaactaaataatatgttatcaataaaaaatgaacacgtttatcaacgtttaagtaataatacaatcatcaactttcatgtcatttaatttacaaaatttagtcttcctagcattactcaaatttgaatgattgtgaaaataaattaaggttggtgaggactttgacataaatctaaatataattaagaaggctctaaggtagttctattcacacactcgtttttacttctttcacactcttattaatttttgtctattgatcttcttcaattaatttaatctgacgatcagaaatcgaaaatagtatgtgagaagtaaaaattaatgtgtaagtagcactacccgtggctttatatatggtgcccatgtcaaatcgacgcattttggtggctccatatatttgcacgacaagtgccctggctagtgaccatgaactagttgtgtacagttgtgtgttatctctcatcatgtggaaaagttaattaattaaaaaaagtttataacgacatgtgtacaactatgtatcgaccgtggtataagaccagaagaagtactgtatatcatataacataggatagttggcttgatggtgcattccaaccgatacatgtgtggaggaagtgttgtaaatgccttgttgagctgcatcagcatctgtgtgcgagagagagagtgaatgaatatattgagttttggtgggcagtgaaaagtgaagtgagaaggacgtgaggccttttccttgtaccatgaggatgcgtttgttacaccttcttaagagattggcttaaactgacttaactagaactataattctacgtttggtatgtttctggactagattaaatggaactcgctccaactaacaatccctccacgtttcgttaaagctcgttatttagttcggagctttcgcttggtattaagcatgactaaaatggaaaacgaggccgacgcttggtcgtttgctacacccgacatccactctgccttctttctgcttgcaccgttactatggccaggtcgtcggcggtgccttctcttatgtggcccaaccttaggtgatagctgcagctcacagctgaagaggcgctgctttaggccaaaatcgcgagtcggtggaggacctggcaatgctaccgtcggtgggcgttgctgacgagaagcagatcaagagcttgacgatgaaggttgggaagatctgtacaatattatgcgatttgattatttggttgcaggattgggagatctgtacattttttatgcgatttggttgctgacatgattgaatgagaaaattaattagcttttaaaagttaagataactataaaataagtgagagagtggtgaaattgtggagataaaaaggtaagtggaggagcatgccggagaaatcgagaaggggaagttgagcagagtttgatgggagaaggattgcagtaagaaattaattttgatagaaaagaaattaattttaatagaaaataaaataattaaataaaaattattgtacttttttatttgtaatccaacactacattaaacgtttcactaaatcaatctaattaaatttagtccttgaagctagtccagtccgaaatagt

SEQ ID NO: 83 - DNA, 6148 bp, Pyrus x bretschneideri
  source 1..6148: /organism="Pyrus x bretschneideri" /mol_type="unassigned DNA"
  misc_feature 438..586: /note="n = a or t or c or g"
aaactaatgaatgatattgtggtgatgctacaacacgcaatctaatctaatcttgtaatcttatcttaggtttgaagtacaaattaaccccatttatcatatattgcagtgaggtgaaaaaggtttgaaatggtgaaatgaaaccgtcaatggctggaaagtctaaaccctgacagctacttggtatgtctaataaggttgagcatcaaatctatcacatttcagatacaatacttactaataaattcatcatgcatgattcacattgaagagatcgggggttaggtgtagccaaatagggttttacccaaaaattaaaaagaaacccacaaaataaatcaagattgattttccaaagaagcaccatcttaatttgacttgtaatttaaggaaccaatatgtaactcacacacacacatatatacatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaggaaacaaatcaacaatcgtatgagattggatcagtttggtgaatatatttatatttgggtggagaggaccaatatgcctcacatgtatgtgactagttcgacgaaagtccacaatggcagcagctcttcttgttgccttccagccatggttgaactttagaaccattaatttatttttctcaggaaaacattaataaaaaatgtcaacaaatattatccaagattcgtctgtaagttagtttgtctaaattgcaagagctgaactcatttcttgtaagtttagttttgttcattagtccttttattgaaggagtttcagataatcaattccatttgctgtacgaaaactctgttaattaacttaattacacgtatctctctttcgtgttaatctgtttgagaagtacttaggtttccaagacatataaattatttcaaggccccacataagatatatcttttaaccaaaccatgttttcttgtaatcatgtatatgcataataatattttattttgacaacatgatatgacgtctataacgtaaaaattaatattgttataacaataataatgtcattatgtgttatttaactaaaatcttaccattattatgtaaccttagactataaatcttgacgattacggtataattaaccttacatttcttgtagttcagacgttgaatgttaacattattttataacatcaaatgtgaaggtaaagacccaaaagtgaatactgatgaatgtgagatttcttgacgtctatttttattaacttgcatctatagacactataatataacaagacatccataaccatcaaacattagtgtaacaatatcattccataacctcgatcactatttctgtaacgtttaatagtaaatgacaattataatataattgttgttagacgaatggtagcgtagaaatttgctttattaatttgggacttagttgtaaaaatatcagttgttttatttcagacaaagtcaaattgaagcaattttgtaacgtcgttcctatgagtagactcaaccaactctctcattttcgtttgttttaggtggcgtcttactactaactaattaatactcccatgtccacacttcatatatctataatcaaattcctacgtctctagacgtcaaaacggctcgtatttggataatgagaaaaaaagaattcaatccaaaatccgcaaaacttggtttcttgtcccatactatttcttttcttttccgactttcattaccataaaaatactataaacaaaactaaacaatctcaattgtttttaaataatttatttctggatagccgaccaaattccactgtagcactaaccctaaataaataaataaataatccaacagttgcacaaaccttgtatataaaaggccctactacttctgctaatcattcccacgaaaaaaagacaaaaaaaaaaacaaataacaaaataacaaaataacaaaagaaacacacacaatatggattctcttctgcaatccttgcaacccttacaatccatgacaccactcttgctcataatcccactcctatttctcctccctctaattttccgtttccggcgaccaccaccatacccgccgggccccaaaggcctaccccttattggaaacatgttattgatggaccaactaactcaccggggcctcgccaagctggccaagaaatacggcggcatattccacctccgcatggggtttttacacatggttgcgatttccagccctgacgtggcacgacaagtccttcaagtccaagacaacatcttctccaaccgcccggccaccatcgccatcagctacctcacctacgaccgcgctgacatggccttcgcgcactacgggcccttctggcgccagatgcgtaagctctgcgtcatgaagctctttagtcgcaaacgcgccgagtcctgggagtctgtcagggacgaagtggactcggcggttaggaccgtcacagttcatgttggttcggctgtaaacatcggagagttagttttttcgctcacgaaaaatattatttatcgggcggcgttcgggacgagctctcaggaagggcaggatgagtttattgggatactgcaggaattttccaaattgtttggagcttttaatattgctgattttattcctagcctggggtgggttgatcctcaggggctaaacaatagactcgctaaggctcgtgagtccttggatcggtttattgacaccatcatagatgatcacatggagaagaataggaatggtaagggagtgagtgacagtgaaacggacatggtggatgagttgttggctttttacagtgaagaagctaaagtaaatgaatctgaagataatttgcaaagcgccatcaaacttactagggataacatcaaggccatcatcatggtaaataactattacacaatttcatgttacataattatattataaccccacaggttgcatgtttatgtaacctgttttcttggactaaacttttggctaattttttctttttatctgatcagatatattaattgcgtattgagactatgaagatagaaagttcatagtatattattttgaaaactgattgtttaaattgacgatctgactaggtatacaacatgctgtatatgcaaattaataagctaattatatatgctacgtattttcaggacgtaatgtttggcgggacggagactgtggcgtcggcaatagagtgggccatgtcggagctgatgaagagcccggaggacctaaagagggtccaacaagaacttgctgacgtggtgggtctagaccgtcgacctgaagagaccgacttcgagaagttgacatacctaaaatgtgccctaaaagagacactacgactccacccaccaattccactactcctccacgagacctcggaggacgctgtagtagccggctaccgcattcccaaaagatcgcgtgtgatgatcaacgcgtgggccattggacgtgacaaggactcgtgggaggacgccgagtccttcaagccctcgaggtttttgaaagaaggtgtgcctgactttaaggggagtaacttcgagttcattccgttcgggtccggtcggaggtcgtgcccgggcatgcaactagggttgtacgcgctggagatggcggtggcacacttgcttcattgttttacgtgggagttgcctgatggtatgaaacctagtgagctcgacatgaacgacgtgtttggactcacggctccgagagcgagtcgactcatcgccgtaccaagtaaaagggtggtttgtccactctgatggtgatgaaaaaacagcgttcgacgaggagagataaacagtggtgcaatttgtttggagtgtaatgatactgtgaaaactgcacaggtagattgcaagcgtttttttattgttcttttgaaaaactaaataattacaaagagaccatgaacagttgtgcgggaatttttagttctctctctttgtgtatatacactctcttttgttttgtttaatatgtatgcaaatttatctttaatttcctctcttttttcctttttgttttgttttgttattattgtattgaaataaaaatataatggctaagttacaaaaattatttgtcatggtggaaaaattgatggactgcttatgttacgatttcaatttgttttctgggtcggcggcaatagtaaaattattttgtttaaaaatgaatgaagaaagattaagtaaaattaactcttgaacaacggtagaataatgttaaatcatgcttacgacagaagtagctcacactgtcctcagcagttgtgaagattgacacttaatttgactgatgcaggtcaattatacatttattttgtggttaaaattattacataaaaaatatgaagagtaaggctatggagactaaatttatgagctaaaattgcaaactaaatgatatgtcatcaataaaaaaatgagtatgtttatcaacgtttaagtaataatacaataatcaacttcaatgtcatttaatttacaaaacttaatctacaaatttagtctccctatcattactcagatgtgaatgattgtgaaaatgaattaaggttggtgaggactttgacataaatctaaatataattaagaaggctctagggtagttctattcacacactcatttttacttctttcacattcttattaatttttgtctattgattttcttgaattaatttaatctggtagccggaaatcaaaaatagtatatgagaaataaaaattagtgtgtaagtagcactaccctggctctatatatggtgcccaagtcagatggatgcattttggtggctccatatatttgcaagacaagtgccctagctagtgacccgaagagatcttatttatgaactagttgtatacaactgtgtgttatctctcatcatgtggaaaagttaattagtatatagacaaaattatctgtaactagtaattaaaaaagtttataaccaaatgtgtacaactatgtatctaccgtggtataagaccagaagtactgtatatcatataacataggatagttggcttgatggtgcattccaaccgatatatgtgtggaggaagtgttgtaaatgccttgttgagctgcatcagcatctgtgtgtgagagagaaggtgaatgaatatattgagtttaggtgggcagtgaaaagtgaagtgaggaggacgtgaggccttttccttgtactataaggatgcgtttgttacaccttcttaagggattggcttaaactgacttaactagaactataattctacgtttggtatgtttctggactagattagatggaactcactccgactaacaatccctccacgtttcgttaaagctcgttatttagttcggagctttcgcttggtattaagcatgactaaaatggaaaacgaggccgacgcttggtcgtttgctacacccggacatccactctgccttctttctgctgcaccgtcacaaggccaggtcgtcggcggtgcctgtcttatgtggcccaaccttaggtgatagctgcagctcacagctgaagaggccctgctttaggccaaaatcgcgagtcggtggaggacctggcaatgctaccgtcggtgggcgttgctgacgagaagcagatcaagagcttgacgatgaaggttgggaagatctgtacaatatcattcgatttgattatttggttgcaggatggggagatctgtacatttttttatacgatttggttgctgacatgattgaatgagaaaattaattagtttttaaaagttaagataactataaaataagtgagagagatggtgagattgtggagataaaaaggtaagtggaggagcatgccggagaaatcgagaaggggaagttgagcagagtttgctgggagaaggattgcagtaagaaattaattttgatagaaaagaaattaattttaatagaaaataaaataattaaataaaaattattgtacttttttatttgtaatccaagctacgttaaacgtttca

SEQ ID NO: 84 - DNA, 1551 bp, Pyrus x bretschneideri
  source 1..1551: /organism="Pyrus x bretschneideri" /mol_type="unassigned DNA"
atggattctcttctgcaatccttgcaacccttaaaatccatgacaccactcgtgttcataatcccactcctattcctcctccctctaattttccgtttccggcgactaccaccgtacccgcccggccccaaaggcctacccctcattggcaacatgttaatgatggaccaactaacccaccggggcctcgccaagctggccaagcaatacggcggcatattccacctccgcatggggtttttacacatggttgccgtttccaacccggacgtggcacgacaagtcctccaagtccaagacaacatcttctccaaccgcccggccaccatcgccatcagctacctcacctacgaccgcgctgacatggccttcgcgtactacgggcccttctggcgccagatgcgtaagctctgcgtcatgaagctctttagtcgcaaacgcgctgagtcgtgggagtctgttagggacgaagtggactcggcggttaggaccgtcacagttcatgttggttcggctgtaaacatcggagagttagttttttcgctcacgaaaaatattatttatcgggcggcgttcggtacgagctcgcaggaggggcaggatgagtttattgcgatactgcaggaattctccaagttgtttggagcttttaatattgctgattttattcccagcctagggtgggttgatcctcaggggctaaacaatagactcgctaaggctcgtgagtctttggatcggtttattgacaccatcatagacgatcacatggagaagaagaagaacaataagggattgaatgatggtgagacggacatggtggatgagttgttggctttttacagtgaagaagctaaagtaaatgaatctgaagataatttgcaaagcgccataaaacttactagggataacatcaaggccatcatcatggacgtaatgtttggcgggacggagactgtggcgtcggcaatagagtgggccatgtcggagctgatgaagagcccggaggacctaaagagggtccaacaagaacttgctgacgtggtgggtctagaccgtcgacctgaagagaccgacttcgagaagttgacatacctaaaatgtgccctaaaagagacactacgactccgcccaccaattccactactcctccacgagacctcggaggacgctgtagtagccggctaccgcattcccaaaagatcgcgtgtgatgatcaacgcgtgggccattggacgtgacaaggactcgtgggaggacgccgagtccttcaagccctcgaggtttttgaaagaaggtgtgcctgactttaaggggagtaacttcgagttcattccgttcgggtccggtcggaggtcgtgcccgggcatgcaactagggttgtacgcgctggagatggcggtggcacacttgcttcattgttttacgtgggagttgcctgatggtatgaaacctagtgagctggacatgaacgacgtgtttggactcaccgctccgagagcgagtcgactcatcgccgtaccgagtaaaagggtggtttgtccactctga

SEQ ID NO: 85 - DNA, 6142 bp, Pyrus x bretschneideri
  source 1..6142: /organism="Pyrus x bretschneideri" /mol_type="unassigned DNA"
acaaaaccccttgaattagtttaattaggagcgcagttgctattagcttatttatttacttgacgcataggcataggtgggatagggctttgctttagcataggccaaaaagaagctcaataagccgaaatatagtacgtgtaaaccccttagttcctcttctttaccatagggtagggggtgtgaagctatagaaacaaaaaggctacttaacagctactaaagccaatggcgtagccacccacaggttaaggtgggatgtagcccagtgaggtttttttgtaagagtagtgttatttatgcactcatttttacttttcacacatctttcttaattttcagttgtttgaatcaaatgagatggagataatcactgacagaaaattaataaggatgtgttggaagtaaaaatgggcttgtaaatagaactattcttttgtaaaatcatgtttacagtttactcaatttcaatagagattattatttaatgtatattttatagaagataggtaataaataatacattttatgctaaaaattataaattagttctatctacaatcctttttttatcatattctttaaagaaaaagaccatttaccctatgtaatttagcctttgtgcttcttactcaagaaaagaaaaataatttctttaaatccacaattaaatccttgtctccacaatattccttaatttccgtagcgattttccaataaatgtcacctttgtactttcttaatctctatattattcttgatttaattagtaggttaattatttatatggtccatgaatttatctgttaaggttatgattttgagaataatttatattatattgttgttcttttatattgattattatataagtttatacaagcaaaaaataaacatatgattttatagtactttttttcaattagcccacccaaagaaaaaatcttggctccgcccttgactaaaggaacgctattttgctattttacagcttgaaaatggctcctaaagctaactactagcactagcaagagctaatagcaaaaacagagctagtagctagccgcttctatctcttcctatatagcttagcttcaaaatagcccaaagcaattgtcctatagagcttccaccttccctacgatattaatctttaaaaaagatttagtttagaaaaaaaccgtatgcaagattaataattaaattaagtagctgacccattagttatcatttatttctttgttattcttccaattatacccttttgtgattgtttgtaatgaagacttttttttttggttaacaatcataggacgtcatttattatagcttatctttaggatgtatatgatattttgtagtagtttttttttttattttcattcaaatttcaaactgattttagttcatattcgagaaattagtaattcatattctaaaattaagagggctatacatatagtatattgtaatgatatcaccttttttatatacatattattgtggtaggtaccatgatttaagtgcatttgacttggtactatgatttatgtgcatttgattatcactaatatttttttggacgtctagatgaggtatgtttatcatttgagaaagtcaaataataatcaatgccaaaaaatatggagcaaaataaaaccaaatatttaatatgggcattatgggaacaaaaaaaaaacattaaatatttaaaagctagaaaatatgtattttaatatttatgatgacatggaaatttagtcaaaagactataatgaatataaaatctaacataaagttttaattgaatttcaatatttatcaaggattaaaactgagaaacccctagtttaattcaagatagcatgacccaatgtaacagcaacaccataaaattaaaaatataaaaatcaaacggtagcacaaattttgcatataaaaggcaccacaatatctcttccaacttaattagctacattttgagttgccctacaacttctactaggcatacccacagaaaaaagtaaaaaaaaaaaaacaagaacaaaagaaacacacacaatatggattctcttctgcaatccttgcaacccttcacatccatgacaccactcgtgttcataatcccactcctattcctcctccctctaattttccgtttccggcgactaccaccgtacccgcccggccccaaaggcctacccctcattggcaacatgttaatgatggaccaactaacccaccggggcctcgccaagctggccaagcaatacggcggcatatttcacctccgcatggggtttttacacatggttgccgtttccaaccctgacgtggcacgacaagtcctccaagtccaagacaacatcttctccaaccgcccggccaccatcgccatcagctacctcacctacgaccgcgctgacatggccttcgcgcactacgggcccttctggcgccagatgcgtaagctctgcgtcatgaagctctttagtcgcaaacgcgccgagtcgtgggagtctgttagggacgaagtggacacggcggttaggaccgtcacagttcatgttggttcggctgtaaacatcggagagttagttttttcgctcacgaaaaatattatttatcgggcggcgttcggtacgagctcgcaggaggggcaggatgagtttattgcgatactgcaggaattctccaagttgtttggagcttttaatattgctgattttattcccagcctagggtgggttgatcctcaggggctaaacaatagactcgctaaggctcgtgagtcgttggatcggtttattgacaccatcatagacgatcacatggagaagaagaagaacaacaataagggattgaatgatggtgagacggacatggtggatgatttgttggctttttacagtgaagaagctaaagtaaatgaatctgaagacaatttgcaaaacgccatcaaacttactagggataacatcaaggccatcatcatggtaaataactattacacatttttatatcagagattataaccccacattcaggttgcatattgtctctgtaacctgtattctttggactaaacttttggttaatttattctttttatctgatcagatataatatattgtgttgattgagattatgaagatagaaagtctaacatatttaactttaaaaataaataatagtttaggttgatgatctgaatacataacatgttgtatatgcaaattagtaagctaattgtatatgctatgtacatgcaggacgtaatgtttggcgggacggagactgtggcgtcggcaatagagtgggccatgtcggagctgatgaagagcccggaggatctaaagagggtccaacaagaactttttaacgtggtgggtctggaccgtcgacctgaagaggccgacttcgagaagttgacttacctaaaatgtgccctaaaagagacactgagactccacccgccaattccactactcctgcacgagacgtcggaggacgctgtagtatctggctaccacattccaaaacaatcgcgcgtgatgattaatgcgtgggcaattgggcgtgacaaggactcgtgggaagaccctgagtccttcaagccctctaggtttctgaaagatggtgtgcctgactttaaggggagtaacttcgagttcattccgttcgggtccggtcggaggtcgtgcccgggaatgcagctagggttgtacgcactggagatggcggtggcgcacatgcttcattgtttcacatgggagttgcctgatgggatgaaacctagtgagcttgacatgaacgacgtgtttggactcaccgctccgagagcgagtcgactcgtcgccgtaccgagtaaaagggtggtttgtccactctgatggcgatgaaaaaacagagttggattgaggagagagaaacagtgtgcaacatgtttggggtgcaatgtcaaagtatacatacagtaaaaatggcaggtaaattgcacgcgtttttaattgttcttttgaaaaacaaaataattacaaagagactttaaaaagttttgtgggactttttatttctctctgtgtgtatatagacagtctcttgttttgtttaatatgtaagcaaatttatctttaatttcctttttgttttgttttgttattattgtattgaaataaaattagtggatgagttgcaaaattatttgtcatggtgtaataattgatggactgattatgttacgattttaattttaatttttttttttggtcggtaggaatggtagatttatgtacagttgtgcttgcgatataagtagctcatactgtcctcagcagctctgaaaactgacactgattgacttatttcgattgtacttatttggtggttgaatttgttatattaaagatgtgatattgtgcggatggtgagaatgaatgaatgttggtgaggacgttgacatctaaagctaaatataattaaggcggctctatatatggtgcccgaatcagatcaatgtctttggtggctccatatttgcaagaaaagtgcgccttttgtaaatactatttatttggtatataagcgtgtcctagctagcgacccgaagagatcttgtttacgactagctgtgtacaactatgcgttatcttatacatttatacaactgtgcacacgtatagaattgtccatatgtatatgtaattagtaaaagaatttcttgtttgtataattagttttgtacaactatatgtctatctgatctatggtatatgaccagaagaagtactgcaaagcatatatataggacagtgcactagttaacctatgtgtgtaggaaatgttgcagtgaatgcccttgttgagctgcatcagcatgtgtgtactttgtacaaccgagagagagagagagagagagagagagagatggaatattgaggttaggtgggaagtgaggactcaaagtgagaaagacgcgaggccttttccttgttttctttaagtatataaaaatatatcgatgatcatgagtcacagtgatatatttatttagagtaatgctagggagattaaatttacaaactaaatgatgtgtcaccaataagaaatgagcacgtttatcaacatataaataataatccaatcattaacttccatgttatttagtttacaaatttagtctccataacattattcatttgtttgtgtgtgaaagaagattgtgcttatcagtttatgtatgtataactgcgagagctggaaggggatccatcgaagattttccgccctcaagtaacacctggggttttctaaagtttggtggcttggtgctcaagaaataggacgcactgtgctcggttatttaacttgagttggcaaatggactgggattgagtacctatccagatgattaaatatatatctttgcatttgccaatatattatcacctttttgtttgttctttttaatatggctaaatatccaaaatggtgtctgagatttgcataatcaatagaaatggtccttgagattcaaaatcaatagaaatggtccatgagattgtctaccatccatgattttgttcattccattaaaaactctttaggcaattttcaaaacttcgtaactcaatcaattcttaaccaaattcgacccataatatatcaaaatgaagataggaaagtgtagaacaagattatacctatttggaagcccaatggttgccggagatagctggaaaacagcctgaaaggtgactggttcgcgggaaaattggaaaactcgccggaaactgggtaaactttaaatgttcataacttcttcaatactcaacgaaatcaagtgattcaaaaacgaaaatcatacttctcaatgagatgaagataatggtacctttctcgatggctaactcctctacttcgtggacgtagccaaacttaggatgaactacgtacatattgtgtttgcttccctatctctatctctttacatacttatcctcactagtgaccggagcaaataagcaaaggtcacaaacttgacactttacattgttccaaagtcttcaccgattttatgcatcaacaagtaccaatatcatcgttacagtttatccatcaagatcatgacctagaattggtc

SEQ ID NO: 86 - DNA, 5937 bp, Pyrus x bretschneideri
  source 1..5937: /organism="Pyrus x bretschneideri" /mol_type="unassigned DNA"
catgaccatagcagctaaagccctgtaacagatctagcatcacactgctgtaaaaagaatagtgatctctgagtttctgtatctcatcgatgacaaaatacctacaatcgtatgtgtcaaatatttattttattattaatatatttggtcccataattacattaattattaaacaataattaaaaatcaattttaatcctattggttgtcaatgagactcatgaattaaacaattaaattaaggcatttgactccatctttgtttgtggtaaaaaatgtcatatatgacatctcctttagagaataccatgatatcttttaatcctagttaacatatttgacatctcctttagacatggtaagaattcaaattattcttcccttcttttgtcgaaattcaattaattccttaattaactggggtataatctgtttccagacaagtggatccaaaattcccactgccacattagtgcattcctcattaaaggctgcagatcccttattaattatatcaagaactctcatagttttatatgaacctgaccaaccccattttcccaacacaaccaaagccatggagctccttcaccaagctcttcaatccctgcaatcttcacccatgttgcttattcttcttcttctcctcctcatcatttcctttatttttttgtttaattcgcgctggaaactcccatatctgccaggtccaaaaggatggcccatcatcgctaacatgctcatgacggaccaacttacccaccgtggcctaacccatttgaccaagcaatatggcggtctcctccatctccagatgggggtcatacatgttatggccgtatcaattcctgatatggcacgcgaaatcctccaagcccaagacagctgatttgccaaccggccagccaatgttgccatatcttacttgatctatgatcgggcagacatggcctttgccaactacggcctgttctggcgtcgcgtgcgcaaaatttgcgttcgtgaatctatttagccgaaaacgggctcatgggcttcggtgcgcgaggaagtcgagatggtccaaaccgtggcagggaaaaccggctccccggtgaatatcgggcagttggttttcgctctgacgaggaacataacatatcgggtggcttttgggtcaagctcacatgaagggcaaggcgaatttgtgaaagattttgcaagaattttcaaagctttttggagcttttaacatgcaggattttttaccatggttgggttgggttcatgcacagggttttcaggacagaatggctagggcatgtaagtcactagatgttttcatcgacaagatcatcgacgaccatagcagctataaccctgtaacagatctagcatcacactgctttaaaaagaatagtgacctctgcgtttctatatataattgatgacctaagtacctacaatcttatgtgtcaaatatttattttataaatatattggtcctaaccatcctatagttactttaattattaaaaaaaaaatttaaattgatattagttgtcaacaacactcatgcattataaaattaaattcaaaccatataagtctatctttatttgcggtgaaaaaagacaactagaaagcaacgtcatatatgacatttcccttagagagcatctaatgtcttttagcctagttagcatatttgacaaaaatggtaagaattcaaattattcttccttcttttgtaaaaagtcaattatttccttaattaactatagggtataatctgtttccagacaagtggatccaaaattcccattggcaatatacacaaaacaacgcgtgacgtttgcaagataaaatacatggcagatatcaccaccaaagtcgccagttattacttcccacattagtgcattcctcattaaaggctgcagatcccttatcaattatataagaactctcattgtttatacgaacctcaccaaccccatttacccaacacaaccaacgccatggaactccttcgccaagctcttcaatccctgcaatcttcacccatgttgcttattcttcttcttctcctcgtcatttccttgattttcctgtttaattcccgccggaaactcccatatccgccaggcccaaaagggtggcccatcatcggcaacatgcttatgacggaccaacttacccaccgtggcttggcccatttggccaagcaatatggcggtctcctccatctccagatgggggctatacatgttattgcagtatcaactcctgatacggcccgcgaaatcctccaagtccaagacagctcattcgccaaccggcctgccaacattgccctatcttacttgacctacgatcgggcggacatggcctttgccaactacggcccgttctggcgtcgcatgcgcaaaatttgcgtcattaatctatttagccgaaaacgggctgagtcatgggcttcggtgcgcgaggaagtcaatgagatggtccaaaccgtggcgggaaaaaccggctccccggtgaatatcgggcagttggttttcgctctaacgaggaacataacatatcgggcggcttttgggtcaagatcacatgaagggcagggcgaatttgtgaagattttgcaagaattttcaaagctttttggagcttttaacatgcaggattttctgccatggttgggttgggttcatgcacagggttttcaggacagaatggctagggcacgtaaatcactagatgttttcatcgacaagatcatcgacgaccacatggctaagaggaaagcaaacacggagaataaggatgacagtgaggctgctgatacagatatggtggacgaattgatagcttactttagtgatgatgctggaaaggaaggtgacgaccccaattctggcttcaagctcaccagagacaatatcaaagcacttattatggtatgtatatttgacaattaaaattttcttaatacgttatatttgttggtgaatagtcacacatcggagaaaaacaaaaataatatacaattttatgtgtgagagatatacttctaatatcatcgagattttttaatgataaaattcaatacatagcaataagtggttaagttagaacaatagatacactttattaatttttaagaaacaaatctgattttaagtatttgttgttaactatttttgtaaggaattaggagagaaaactattctgataaggaattcatgtacttaattattactatatttatcatttccgattgatttagtactaaataatacgattatcccatatatacgtaggatgtgatgtttggtggaacagaaacggttgcatcagtgatcgaatggacaatggcagagctgatgaagagcccagaagatctcaaaagagtacaacaagagctcactgatgttgttggattgaaccgtaggctccaggaaaccgacctcgaaaacctaacctacctcaaatgcgcagtcaaagaatcccttcgtcttcacccgccaatccctctcctcctacacgagaccgtggaagacacctctgtggctggctactcgttcccagccgggtcacgggtttggatcaatgcatgggctattgctcgtgacccgactgcatgggacgagccagaaacattcaaaccctcgaggtttctggacgatggctcgcctgatttcaaagggagtaacttcgagtttattccttttgggtctggtcggaggtcgtgcccgggaatggcgttggggctgtatgggttggagatggctgtggctcatctgcttcattgttttgcatgggagttgcccggtgggatgaagcctagtgagcttgacatgaatgatgtgtttggactgactgcaccaaaagcggttcaacttgttgctgtgccaacttataggttgaattgccccctttgaattaatagtttcaagtagacgaggagacgatgatgatgaaatattacttggttttaaatcagtgatcgatgagtaaatttctctatgtaaaggtactttaacgaataagggtttgttacgttcttggtctctctttaccaattgaataatactattgctttccccatgagggacgagctcattattcctctattgcaaataacaatatcttcaacgtagaaatttcataattggatcagttcaatatcttcatcttcatttgaagatcatccttacaaaaaataatttgaattttttattgtttcatcatccaaatgtataaataaatcaacggtttatcatgaatatgttacttgatacctacacttatgatttatttgatacatttggatggctaaacgatcacctcaaatgattttttggaggaatgatcttaaaatgaagattaagagattgaacggttctaattattaaaaaaaaaaaaaaaaaatctatgttaaagatacgttgcttgcaactggaggaatgacctcgtctcccaatcccaaggagagtatgtaagcattatccattattgtaataatcatttttaattttgtaatatcgctatgtcgttaatatttaatataaatatatgcgtggttgtttgttaacctttgttggctttctgtcctttgtggctcagccttgtatcttttagtcagtttttcgaagacaaaacgggaaaagattccatccagatctctcccaccaaatcctaaggatccgaagatccggatccttaaaatttgattcaacggccacaaacaagaggttcttctaaaaattataataattatagtagttagatcaaatttcaaaggtccggatctctaggacttggtgggagagatccgaaggggatctcttccctgacaaacaagtggggatgtacttttaatgttggactgttgaagtcctggaaaaacatctttcgtcaaactatatagcaaaatagtagtaagctaagacgcttatggtgttagataatggattgaggctattgatcaagatgaatctttcgtaaatttataccaaatttatgatctcacaacataatttgatgaacttgatatgcaatattgatcacacaaagacttcatcttatagaatattggtttatatcctaaaaaattaaatttgtagggttcataaactgttccattaggtggtaacatattaatttgatattgtgatgatacaaagctcaaattaacagtattgttatcaactaactattggtctggtaattttttttttcttccctaatgttggaataaatatcttgatttcgattccactcttctatacaaaagataatataaataggagcatagctttcaacaaatgaccgttgaaataaaaattttgagttcggttccttccttccacacgaaagataatataaatcaatagcatagctttcaacaaatgacggttgcatttagacgaaaacccttaaaagtttgccgaccctttgacacgtagataagcaaataatataactagctaattgaagtggttgagaaatggacattgtgagattagaatgcgttagcaattgcgcaatgcaaactatgatgtcggtagaaggtgaaaggataaacctcagccaatgacattctatgcagctgtttagctatagctttttgagtccaacttcaaggtagaagaacgattactcatcaaataaacttatcattccaatcatctttaaaataagaggaaaaagaaataagtaaagttgcgtcgttgagtgagaaatgaaaaattcatagaaagttacaacccctaccacgtaatagtgcacctacatgccttcatcgacgttgtttctcaattggatagataaacgttttcttctaagtctaaaccccctttcatcgatgttgtttctcaattggatagataaaagttttcttcaagtctaaaccccctttcatcaagtggtgaattgacacaatgactaggacat

SEQ ID NO: 87 - DNA, 6246 bp, Prunus persica
  source 1..6246: /organism="Prunus persica" /mol_type="unassigned DNA"
accgagatcttttgtgataaaacttcatacttattaagctttgtagataattaaattgtaaataatatcgatgttgttagttgtgtactactagtctttctgaatttaacatctacatcataagcagtccacatcacatattatacatctgaccttttatacagataatcttttgtataccaaacaatatagtaagtccccagtaatgacttgccacgttagcccaatcttcataaaggctgcagatcacattttaattatataagaacctcatccttttcttttcaaccttatcaaattcataatttatattaacctcctcaccaaccccattttcaagaacacaaaccaagccacggatgatctcctccttcaccaagcacttgaatccctgcaatcttcttccatgttgctcgttcttcttctactcatctttttctttattgttttgttcatgtcacgcccaaaactcccatacccatcagatttgaaaagggtccaatttcattcaattactgctaacacacctccaacccccaactttcttcacatatgatggcaatttgaaaattagaagttaacaaattagtgagaaaaaggagacaaaatcgctagtcttggcgtagccaccgaaagggtgagaagaagattgagcaatgattaagctgttgaagagagagagagagagagagagagagagagagagagagggagagagaggccgagaaggcagcgcgaggttgacgatgggttggggtgggtggtggctattttcttttttcattgagtaatgctactcttactacattcttgtaccaccttacttagcagataaagtgtacagctacatcaattagaaactgttaataaatcataaaagaaaaaaaaatattcaattaattttaattgatgtggattgtccaccttatctgtcacttaaagtggtatacaaatatggtaagagtagtattattattttttttttcttttttgattttcttagttttatttaaaaggataataataattagattccaagtccacctataaaaaaatataaatttttattcttaaatgacacatggcaaattttcaattggagtatcacaagttgagatggtagtggagtaccactaggggtgtacgtcgatttgaaactaatacaatttaatccatattcgatccaatataaattcgattgtgatattttcaatcctatccaatcatattagatgtttaaattcaatcggatatgatccaattgatattggactggattgggttggatgattggttttgaacttttgataatgaaaaaaatataatattgaaatattaaacatttattcttaggtttaatctaatcaaacatattaagacgtaaatgtaaaatataaatgaaatatcagagaaaattgttttgattatataatatattaaatataattccattaaataacttaaaatattcataacattttcaactacaactacctataagagcaaaataagcattactataatattagaccaaattttagctagctaattagtatgtttgaattaatttccttataaaaattatacgatatgtaaataatatcgacacgaatcccgagtttctagatttaaagacattccacttctacataagcagcccagatcacatattatacatgtgaccttttatatagatccttattaatcttttgtatacaaaacaaaacgaattaaaagaaatcccaatacaatttcaaatatttccttagtgcagacaagtggagccaaattcccacagggaatggagttggtgagattagatcatcctctattgtaagtccccagtaattacttgccacattagttcaatcctcataaaggctgcagatcccattttatatatataagcaactcatccttttcttttcaccttatcaaattcataatatatatatatcaacctcctcaacaaccccattttcaagaacacaaaccaagccatggatgatctcctccttcaccaagcacttgaatccctgcaatcttctcccatgttgttcattcttctttttctactcatcatttcctggtttgttttgttcatgtcacgcagaaaactcccatacccaccagggccaagagggtggcccattattgggaacatgctcatgatggaccaactcacccaccgcggtttagctcaactggctaaacaatatggtgggcttctccatcttcagatgggggtcttacatatcatggtcgtatcatccccgaaagtggcccgagaaatcctccaagtccaggacagttccttcgccaatcggcctgcaaatgctgccatatcatacttgacgtatgatcgggccgatatggctttcgccaactacggcccgttttggcgtcgcatgcgtaaaatttgcgtcataaatctgtttagtcggaaacgggccgagtcatgggcctcagtacgtgaggaagttgaagagatggttcgacatgtggcaacaaaaaccagctcaccggtgaatatcggtcaattggttttcactctaacgaagaacataacttatcgggcagcgttcgggtcaagctcccatgaagggcaaggagagtttgtgaagattttgcaggaattctcaaagctttttggggcttttaacatgcaagattttcttccatggttgggttgggttcatgcacaggcttttaaggacagaatggctaaggctcgtaggtcactagacgtgtttattgataagatcatcgatgatcacatggctaagaggaatacaaataaggccaagaaagatgacaatgaagctgaaacagatatggtggatgaattaatagcttttttcagtgatgatgctgcaaaggaaagtgacgaccccaattctacctttaggctcaccagagacaatatcaaagctattatcatggtaagtcttacatgaaaatataatgaggattcataatatctccatattattatcgtcagcaaaatataccgacatgttgttgttgcatttttataatatttatgtgcgtgtccattctttaaataatatatcctgcatagagaatttttgatatatataacagtccatacatagatatttattaataattattttttcaattttaagaaaacctcaacggaatgagggaaataattattcttttaataaacattttaatacattactataattttctttccaatattattaactaccaaacccccgttctactgatcacatcgttctccaatattgttgccctttatttgaggtgccaactcggtctaggggttttcctttttatttattttaattatctaaaattgaaattttttttatttatttaggtaacttcacaagcggattacattgtaattaatattttgtaataggtgggtcaatgcttttttccttttctaaatcaaaagaaacaaatctgatttcttgtgttttttactatatttactcagaatttatggtaaaataaagcacattctcatttctcactcagaagatcaatattatgtgttcaattttggtaatggaaattatgtgtttaattatcactctgtcacttctgatttaccactttgcattcataggatgtaatgtttggaggaactgaaacggtggcgtcagtgattgaatggacaatggcagagctgatgaagagcccagaagatctccaaaaagtgcagcaagagctcatcaatgttgttggcttgaaccgtagggtccaagaaactgacctcgaaaacctaacctacctcaaatgtgcagtcaaggaatccctccgtcttcacccaccaatccctcttctcctccacgagactgcagaggagacttccgtggccggttactcatttccagttgggtcacgggtttatattaatgcatgggctatcgcccgtgacccgactgcatgggatgagccagaaacattcaaaccctcgaggtttttgaaagatggctcgcccgattttaaagggagcgacttcgagttcctcccattcgggtcgggccgtaggtcgtgcccgggtatgcaattggggctgtatgggctggagatggctgtggcccatcttcttcattgttttgcatgggagttgcctgaaggaatgaagcctaatgagcttgacatgaatgatgtttttggcctgactgcacccaaagcagttcagcttgttgctgtgccgagttacaggttaaattgcccgctttgaatagtttgaggagattgtgaaatacctttggttttaaaacagtgatgagcctatttctttacgtattggtactggccgccggtcctgaatttttcaggccccagggcaaaagtaaaaattatgcccttatatatattttaaatttagtgatgaactcactttcatttttcaaccaagatttaacctgttcacattaactaaacatttagcaaataaattatttcaattcaaacttcaaaataaaaggctacaatgtataaacaagataaatacttgtaacaattcagtaagttctttttcatccggcaacaagcaaccaacaaatcaaaaatttatatgcatgctcaatagccaaagcaaaacaacatcaatctagttgaaatccctttgcatcctcgtccaccagcaaaataaaaaatgtctttgcatcctcaacaacacaaagaacaacataacctggaatttgagaaatccccctccacaacaacaaacttgatatttccaaatttgcaatcagttagatcttaaaagaattcttgcaaagagaatgtgtaactcatgtgagttcacaaatctacaaaaaaaataaaaatgaaaaaataatattttccttttcatttgatatcaaatcatgaaaaattactttcaattgatttttacaaggactgattttgtactgaacaaaagtccacactttgaattttgtaatctccctaatctaccaatagaaaaattaatttagggattcacaactctgtaactagtaggagaggcttaaatgagatgagaagaagaagaggaagaacgagaaaaagaagaagaagaaaaattttaaatagataaatctaacgttaacctggaggagtggagcgggttgcgcaaaagggttcttcttgagaagcgaaaaggatgcacgttcttccaaaacaccatcttttttttttttttttttctcaaaaatattaaatcagtttataataatataatataacacttttttttaaaaaaaaattgagcccttgaataataggcttagggcggtcgcactaacggcccttgttcaggccgggcctgttttagtcttctatttgttcaggccctatcactgactcgttagtacagtttgtttgtatggatcgatcaaataaacaaaccaaaatattcccaataagaatcaaatgattaaacaatgttggctaatttttataaggggtgatctttgaatgataatctgaaaaacgaatgtccaaattatgagattatattgctaagtggaccaaaaaagtgatcaatgccgtattaacttactaatcgattaatgcttgatcactcctgatcaaacaactaagccacataattatttatgtaaaaatttggccgcaagtaacaaaaattacttgtagacgaaaacccatatgttagcaattattttcaaacgaaaatatacaaaccgctcccttcgtgtgatgattaatttgttcatacaaggaggagggagggaggaacatttcaatttaatcatacaactgggatcatgccatttcaggcattgggcttcttttatgctataaattactcatacaatcaaaattgttacttaggccttctacggtaagggtatagaatgtcatccacactctgtttgatatagcttcccactctattcacattcttagcaacacctgatgctactagtattgcattcctcttaaacctgcatatatacaaatactcagagttttaaagtctaacaagaacaaactgaactggaaaactcaaacacaaaaccatgtgaaaaaaagaaagtcatggataacttcttttctttgctaactcaaagttctaccatacctgttgagatattcatctcctgttgaatgtggtggtctgtagctttggggttgaggaatcggccgaacattttctggagacacaccaagaatttataaacaaggttgctgtgaatgttataagaaaattcagtcattttgcaacactaa

SEQ ID NO: 88 - DNA, 5782 bp, Prunus persica
  source 1..5782: /organism="Prunus persica" /mol_type="unassigned DNA"
agcacatctaaacttatcatttttgggggatttaagtcataatgatttagacacctcaaaatgggccatgatttatcaactaatgaggcatggctttgggtgctctgaggttttccacagcgcgattcacactgctaatggatgaatgaaatgaatattatttgatgaaaatgaacgagtgggaaaatatcaaatcaaatcccacagggcacagggcacaggccacaggcattgaattaattattaaaataatgatgatgttatcatgatgctaaaacacgcaatctagctacttatctcctaattctgtaatcttatcttagttttgaagtatattaactaaacacaacaccatttaacacattgcatttccataaaatatttggaagagaaaaaagaggttgaaatggtgagatgaaacagtcaattgctcgaatgtctaaacctcgacagctacctgaaatgtataaggtcctgcatcaaatctttcacctttcacatggacagactgaccaattgttatgtgaagcctcaaacatacactttgctatacactaatgaatcatcattcacgttgaataaagaattaggtggccagctagctgtgctagctttaaccctaaagacaaatagaaactcccaaaacaagctcggtttgttttctaagcaccatcaatttgaattaaaattcaaggaacaaaaattcaataaattatttagtgaaatatgtacctatccgggtcactattttttggcttaaaaatgttaaatgataagatacggttaagatggatggttttttaagtaccgtttataacaaaatttctgccaacaaaatctagcacattagaaagggacttagtactactaaaaaaaagaagatgaatgaggcatgccatcatgaagtgtttttcctgattaattttgtgaattaaacaaagtatactggacccgaatgttaaatgtgactagttcgaggaaagtccacaattgcagcatatgttttttttgtcttgcagccatggtggaacttttcggaacattcatttaacatttgttgaaattcgtgcacaccatttattattgagcttgcttgttcttttattagtgatacatatttgcgaaagttgagttcatttcttgcaagttacaatatagttactcaattgcgggaaattgagataaccaatttaaattctgctaactaacttcttgcaattaacttaattatacatctctcactctctaaaagtcttgacttcaagtcctatcatttgtataatgcgtgtaattttaatatattatcgccactttcaataaaaaatattcttaaaacaatgttatttcaccttcttattctttaaataaaaaagaaaaatgatacttttcaatcatatacggaagcttcataatatttttttttctctgttaatttcattaattctagaagtattcaattgctttacttcagacaaagtcaaattaaagcaattttcacaaaaataaagtaaaagctacctactctcttttttttttgttaattttatattttattttatatcgaatcgaagtcgactgcaaagaggcgaagaatgcctttataccgctttgactaattgatctaaactcatgtacatattgcagataaatatccctcatcaccgtttataaagaaggaatgttagtacgtatctatacgtcaaagcagtttggaaatccatatctcccagtcttttcccagagtcttctagttttacgcttactcattcagagacaatagtccaacttccatccataccacaaaacataaaataatattaaaacaaaaataaaagacaatttattcaattcatttaaattctaaatcgcgtgactaaattcaacagcagcacacaaactttgtatataaaaggccccataatatctcatccaacttagcaacattttgagttgcacacaacaccaaactactctacgcacccaaaaaaaacacaaaccacatggattctcttctccaagccttgcaacccctacaacccatgacactcttcttcatcatcccattcctcttcctctccggcctagtcttcctataccggtcccgaagacgctccccctacccaccgggccccacaggcctccccatcatcggcaacatgctgatgatggaccaactaacccaccgaggccttgccaaactggccaagcaatatggcggcatcttccacctccgcatggggttcctccacatggtcggcatttcaaaccctgacgtggctcgccaggtcctccaagtccaggacaacatcttctccaaccgccccgccaccatcgccatcagctacctcacctacgaccgggccgacatggctttcgcccactacggtcccttttggcgccagatgcgtaagctctgcgtgatgaagctcttcagccggaagcgcgcagagtcctgggacgccgtgagggacgaggtggacacggctgtccgtaccgtcgctgttcaggccggttcggctgtgaatataggggagctggttttttcgttgacgaagaatattatttatcgggcggccttcgggacgagctcggaggaagggcaggatgagtttattgggatattgcaggaattttcgaagttgttcggggcttttaatattgcggattttattccttgccttggttgggttgaccctcaggggctcaacaacaggctggctagggctcgtcagtcgttggatagatttatcgacagcatcatagacgaccacatacagaagaagaagaagaagaagagtgagggatcgaatggcggtgaaactgatatggtcgatgaattgttggctttttacagtgatgaagccaaagtaaatgagtctgacgacaatttgcaaaacgccatcaaccttactagagataacatcaaggccatcatcatggtaaattattgcgctttctataccatataaaaccacaattaattcggaaaaatctgaaaatgcttacgtattatgttgttagactgtaagtttctatcggataatattattttgaattgattacgaatcaaattcacattccaacaacgtaacatatcagtcatttagtaaactaaataaatgaactaattaattgacatgtgttgcatgcaggatgttatgtttggcgggacagagacggtggcatcggcgatagagtgggccatggcagagctaatgaggaacccagaggagctaaagagggtccaacaagaacttgctgacgtggtgggtcttgatcgccgaccagaagagggagactttgagaagttgacttacctaaaatgtgcacttaaagagacactgcggctccaccctccgattccactgctcctccacgagacggcggaggacgcggaggtggccggctaccacatccctaaaaagtcacgcgttatgatcaactcgtgggccatcgggcgtgacaaggactcgtgggaggacgccgagtccttcaagccctctaggtttttgaaagaaggtgtgccggactttaaggggagcaacttcgagttccttccgttcgggtccggtcggaggtcgtgcccgggcatgcagctcgggttgtactcgctggagttggcggtggggcatttgctccactgttttacgtgggagttgcctgatggaatgaaacccagtgagctcgacatgaacgacgtgtttggactcaccgctcccagagcgagtcgactcattgccgtaccgagtaaaagggtggtttgtccactctgaatctgatgatctcatgacgaggatgagaaaaacagagtttgcatgtgttaattggtgtcccaaaatttcaagtatacataacaatgaaacggcgacgcacaggtaaattgcagggttttttttttttttttcttccttttttttatatttaaaatatttgggaagaacccagaaaacaaataattgaaaagagactttggaaaaacgaaatgagggaatttgtattctctttctttgtgtataaacactctctttgatttgtttcatatgtatggaaatttgtcttggattttctctctttttcctcttttttttttcccttactattgtattcaaataatggatcaatttgaaaaatatatatatttgtcacagtggaaaaaaaataatattattattgcaaacacttggtatataattttgtgtaatttgcaattctttctcgtgactttagggaagatatgtggctggatgtgtgaatatttatattaagtttgtatatgcttgcgactgaaggtgttcatactgtcatcagcaactccaagaattgacacttttgactatttcacttgctatatagtgctaaatgtgaatctcaatataaggctctatggtgcatgaatgagttagagcaaagtattttggtgggtccattgacgaagtttctcaataaatcaatcatgtgatgaaagagatagacacaattatacaatacggagtatcagggtagccgccctgcccgtggtgcaatatgcatcaaacatgtgcatgcaaaagagtgttgtaatgcgcttggtgtaatatactaggtactcacgaaaattatactagtactgagcactggagtggtgcaatatgcatcaaacatttgcgtgcaaaaaagtgttgtaatgggcctggtggcaacaaaacatgtttgtacttggtacaattgatacagagaaggagagagggatatataaaatatattgagtttaggtaggcagtgaggacaagtgaggaggacgtgaggcctttcttgtgttttctttgggtagaataatgagactgggcatgaggttgagaggtgaggtgaggtggagggaggttccatctgagatttcccatcttcaacaaacgtgggatatggacaatagaggacataagggccaccaatatgtaatccaatcagattcagtaggatatttgtatattatatatccatccttgtccctttttgtaaagttggtggcctggtgcttgaataagaccccactgtgcttagaagtttagcttgcgtttgggaaatggagtggggttgaatactatcctatccaatccagttcaaacacaccaacctatttccatcccactccattttatttttaaggcctctgtattgcatttgtgtatatgccgcactcaaattagactgatgagttttgagatcaaactttggaacaccccaggatgtagatgtgtacagagaagacctagagatagattgatgaatgcgtttttatttgttagattggaggaaaccgaactcttaactactcgtcataacctattactccaatttcattccttaccccatttgagttaactcccaaagattttcagtcacaaaataagggttacaacttgaactgttcatctagtgttgaataattaggagttataatgagaggatgcttaatagtcactgattaattgcacagctattagtggaaggtttttttggttttttgttttaaaaagaaacaaaattattaatagatgctatcagacccagccaaacccagcccaacaaacttattgacgttggacttgcatcatattggcacatgagagagagagagagagagagagagagagagagagagagagagagagagagagagagagagagagaggacttaattgaattctaacaagatgaatatttggattgcgtaattgaattcttcctcgggctaggccccacttacaatgtcctaatctttcacatctttatcatatttcttaaa

SEQ ID NO: 89 - DNA, 6020 bp, Musa acuminata
  source 1..6020: /organism="Musa acuminata" /mol_type="unassigned DNA"
  misc_feature 5523..6020: /note="n = a or t or c or g"
ttaattagactaattatatattattttcataattaattattttagtatctcaatcgttatatcttcaaaaattatattgaaatccttatacttattttttctcacctgcctgtgatctcattatgtgagaagacgccaagccaaaattgattgattgatacattgttcgtggtgggagctgtaagcacatcattcggtcactccctttgttcgaagtcccttcagctgaagcatcagaatccacagtgtatttgctcaccggcaaatgaaagtactctgtgaaggtaggttaaggttatggaagacaatgacctctctctctctctctctctctctcttcaccaccatcacccatttctaagtgagcataaatcccagagacttgaatgacaagctcccttcattacgacgtttgcacgcagaaaaaaaccattttttatgtttggaataaaagttaaacaccggaatgaaagattcaaacttatgctctattctgatatatataatataaaagattcaattgggttgctctaatcccaacatcctaaactaataaaagaaaaggacccaattatattttttagataattcaaaaggacgccatgcaaactaaaaaatcatcacattatagaaaggtaatagtttaaataaatagtaagaaacctctcaatcattcacttaacatttaaagatcgattcatgtttaaattcttggggagttaaagtgatgtgatataaagagaaataaacttttatatatgaacaaatattagcgggtcataacacacaacataattaaatggaatcataataaaatagaataccaaaatatacgtggaaaatcccttcaatatgaggataaaaatcacaggacaaactagagataatccactataataataataaatatacaaatctcaatctcttacctaaaaccttagcaataatcacaaaagaataactgggatacaaggatcacatcactgtgcacaatatctaaatccttcataattctcccgagtaattatagtaagaatctattatagatctgatctaatctgagatgaaagcactactagatgattgagaatagtctctctgtattcactttgttttcttttctttctttccctttctttccacgacccccttgatataaatatgtgttgtccttgttcttgtctctctgtgagcttgtgagcttgtgagctgtggattgaatataggctctaagcccaacataaagaactgatggttgcgtgacgcattgacgacatcatctgcatctccgaaatctgaggtctatcttctccacgtacgatgccatcacaatcagatgttagagttccttacgaacatacaataaagatcgagttctttcaaatgcaaacactaaaccacaactctctttttctcacgtctgaattatccgcctaatttaagcataacgtatgaagaaaattgtgcccagcataaaaataatgatttaaaagatttcttggcacatttagattctacaaagtatacgatatcatgtaactaatgagaatctgccttcgacacggaaggcagcagcagctgagtttggtgggagaaaattgccgggtgcctaaaattgtattggctgggagccttctcttcacaccacacgctgtgttctgcgttccaggcgtggggtgtcgtcacaacctcgtcagactaactcacctacttctctccaccccgactgcaatgttgattatggtgaacaatcatgcgtcatcatcatttaggttctctattacactcatcttcttcgcaaaccataaataagtgaataggacatgacgaaaggacgtttgacggattggaattgatgtcacgggaggacgaatacaaacacctgtagagatcaaagatacaaaataaatacgcggcggggatggctattatggaatgagataagcctgtggatcttttgttagtggctatttatatgtggccttctccactcttcttctctcaggagaagatatctcagagagagagagagagagagagagggtataacatatagcggcggcagctatggaatggtctgaagaggtcacgcccctgcacttcatggtatgcttcgctttacctttggtgctcctgtatgttgtcgctacgagaagacgagggaagctgccctttccgccggggccaccgcagctgcccgtcatcggcaacatgctgatgatggaccagcttacacaccgcggcctggcgaagctcggggagcactacggcggcctctgccatctccgtcttggcttcctccacgccttcgcggtgtccacgccggagatcgctcgacaagtgcttcaggtgcaagacaacgtcttctccaatcgcccggccaccatcgccatctcttacctcacctacaaccgcgccgacatggccttcgcccactacgggcccttctggcgccagatgcgcaagctctgcgtgatgaagctcttcagcaagaagcgcgccgagtcgtgggcctccgtccgtgaggaggtcgatgtggccgtccgctccctcgccgaccgcgctggctctgctgtcaacgtcggcgagctcttgttcaacctcaccaagaacatcatcttccgggcggcgttcgggacgcagagccacgagaaccagaacgagttcatctccatacttcaggagttctccaagctattcggctcgttcaacatcggggacttcatcccatggctcagctggatggatccgcagggcatcaacaagcggctcaaggtggcacgagcgtcgctcgacagattcatcgacaagatcatcgacgagcacatggcgaaccgcaaggaggctgatgcatccgatgctgacatggtggacgacatgctcgccttccttgatgagtccggctaccgctgccaagcaggggagagagatgatctccagggaaccctcaagttgaccaggaacaatattaaggccatcatcatggtgtgctccaatatcctatcgatgtctccctacttggttcactttctttgctcctcttcacgcaatacaattagataatctcacatcagaatgagctctctctctctctctctctctctctctctctctctctctctctctctatctatctacacacacacacatacccagagcatgatggtgatgcacgacatcatcaaaagatagcaattttttcctacccaaccacactttagagttattaaaagcatgatattttaattcaaagtagtaattattatttattatgttcttctgaattcttatatgatggttgtttgaatttgcctcaataaactcaattgcttgacgacgcaggatgtgatgttcggcggcacggagacggtggcctcggccatcgaatgggccatggccgagttgatgaagagcccagaggacatgaaacgggtgcaacaagagctggctcatgtggtcggactcgaccggaaggtgcacgagagcgacctcgacaagctctccttcctcaagtgcgtcaccaaggaaacgctccgcctccacccccccatccctctcctcctccacgagaccgccgaggactgcgaagtcgccggctacaccgtccccgctcgctcccgcgtcatgatcaacgtgtgggccataggccgggacaagtcctcatgggaggacgccgacgcgttccggccgtcgaggttcacccccggcggctgcgccgcgtctctcgacttcaagggcaactacttcgagttcctacccttcgggtcgggccggcgctcgtgcccgggcatgcagctgggcctgcacgcgctggagctcgcggtggcgcagctgatccactgcttcacgtggacgctgccggacggaatgaagcccagcgagctcgacatgggggacgtgttcgggctgacggcgccgagggcggtgcggcttgctgccgtccctgcaccacgtctcagctgtccactatactgatcactcttccacaaagaatgagagcgacgcgttggtgggtgtgtttatcttctgctgttcagacaataataatgctttattctatatgaaaacatatatatatatatatatatatgcatgaaatattttgtatcggagattgcttcgatgtacaccacagaataagatcactgattgttgattgcagctcattgcggtgttttccattgtctcatggtggactaatacatcacaagtataagaaatcggccacattggtcggaggtcaaatcgcatccgcatatgcgtccttatttaaagtctttggtttcgcgtcaactccactagcatatgtgattaattatatataccttcaaaacctgtgataatttatttacatcaatacatcccttcaaaacctaaaacttaattctgtatcactataattgatgtctatcagccgctcttagttaaatttataatttctagtgttatcttttagatacttattatgatgttacaaaatattaaaagtattttaaatcatatatttgtttttatttaatcaaaaaattaatatgaaacataatttttaccttaaaaaaatatttcatttaggtcatgaaatttacataagacctataattaattgatgattgatagaaaatacattatcgatcaatctaacatgtgacaaccatggtctaaggcagatgattatgtattgtctctcccttatctcttgcatcgataagagatcaaggggaggctattggaggtaattaaaggttacttcccaacagaatattctgtctatttataattatgtataaaagctcatattcaacataatgaaaaaagatgaaggataacctttttgaccacttgcattcgtactcatatatctcgggttactaacttgagtgttaaaaagatcgggttataaaacctctctcaacctcgatctttgtataggtggcacctcgagagtttaatgtttttacctcagaggcacatcggacaaccgtacgcatacgagcctagactatattggattaaccaagatgtcaataacttcttcctgtaatattttgatactagaagaggacttgatgtcgtagaaatgcctatccatcgattctcttaataaatgctcgagtaaagagactttgccctcaacttatagtactttcacctagggggacaatagacaccctttctgcacatggacatattcacctcagtgtgaatgctaatacgatactagcgtctattcaatgaccagggtctctcacccctagggattgttaggatcgagagcactaagagggggggggtgaattagtgcagcggatatttttcagcgattaaaaaccgaaagctgcgttcgttcgataaagactattttgatgcaaaaagccgattctaagattacttatgattaagtgcagtttacgtttaaacacagttagcgtctaaacgcagtttgcgtctaaatgcagattgcgtctaaactcagattgcgtctaagcgcagtttgcgtcttagcgcagattgcgtctaagtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 90 - DNA, 6058 bp, Musa acuminata
  source 1..6058: /organism="Musa acuminata" /mol_type="unassigned DNA"
  misc_feature 5733..6058: /note="n = a or t or c or g"
ctatcataagttaaaatccatctatcagcgatcttaacttcgaatctgtcataaccttcaatgtggtgggctaatcgatcaatagtctcattgtccataaaattgttagtgctactattatcaatcaaaactataacatgctgatgttctagagttccgccaactttcatagtttgcgggttagaataatcggttaatacatgcattgtattatggtatgcccaacatcttcgttagaatctataccttcatgatcagagtccacattcttagcttttggttcctctccaattggttcaatcatcaaaagttgcccttatttacattgttactccatacttcacttttcatcataatacaaacccatttggaatctttcattgagttctttttgggttagtcttcgggtgtcagagttttggttagccgtagcggaagggaacggacgttggcgcagagtggcaacaccaatgatgaattgacagcgagaagagagcttgctctaggcaagcggctctgataccatgatagaaataatagaagataagaacaataattgaagaagctttattgtagaaataaaatagcattagcttgaatctattaacatgttccctctcctatttatacaaattaggaggaaggatttccctaacagactaaacagaatagagagatttcctcatataattggggagatcttatcctttatcaagttggggaaatctttatcttctatcagttacttgcactcgagggttctaattcgaagtgattggttaaatccaactcatgcgacattttttttcatctcagaaagagaaaacaacattaattattggtggtgaggtcttggattgattccaacttacttcaaccacaaaaagaatgaaaaggaagagagaaagaatcccaaattaggttcatgaagagaagaaagagactctacctctccccctgtatgtcattttattaggttatgaaccaaatccttggttttcagtcccaatcagtgaaggaaaataagaagaatgaaagaagcagataatgatcaacttgcatcttccaagctaagataagaactagcaaccagaattcatttaaaagcggatatattttgtttatgcatctaccatcgatattgatgtaacagctattaaataagaacaggcaaaacttcatcttcgatggtattctttgacatcaaaacattatttttacccttctgatcgtgtaaatagcttagagaacatgactgttcagctacaggtttttttagcatcaaatcatttgccaggattcaaacaacattttcttcaaagatatacgttctttaatgattctttcttgtttcagaggacaccagcatattggactacaagcacaagtgaacttgtacttgatgcttaatgtatcgactcttgtggtcaagcactaataataccacgatccaaacatgtatcctttctcatcaaccgagtccacatctgaatcaagattaattttgcgtggtaagagatatgatccttgtcttgactccttgataccatcaatcagattcccaaaggcagtggaatgactacgtgagctgccatttcaatccctgaacaccagaaactaaaggacaaggcaggaaagaagtagatcgatcctctgtgttacttctcatgtgctgtgctcactgataaggtaggtgacatgcgaagtcttgcctgcactgctcaggtgatgctactcgatccaaattgggtgaagaaaacagcaaggagggtggaatgagatggagcagttgctaaggcctgttcatggatgcgcagatggagtttggtgggaggaggtaactccattcctacgtcgtcttcaacctaccccatttaaatactctccccttctacatctatggcgtccctacgtccccccaccctcaccaagatgtacttagtgatacctcattgaattgattgcagtgagagtcgcgtagtcttctgcgtcagtggctatatatttggccttcccctccgttgtactcttcggggtaagagacaagtgatcgctttagacgatggaatggctcgaagaagtcacctccatgcgcttcgtggtatgtgttgtggtacctgtgacgttgctgcttgctgcttcaacgaggtggcggcggaagctgccgtttccgccggggccgacgccgctgcccatcgtcggtaacatgttgatgatgggccagctcacgcaccgcggcctcgctaagctgtcggagcgcttcggtggactctgccatctgcgccttggcttcgtccacgtcttcgcggtgtcgacgtcggagatagcccggcaagtcctccaggtgcaagacgccgtcttctccaaccgcttcgccaccatcgccatcacctacctcacctacgaccgcgccgacatggccttcgcccactacggccccttctggcgccagatgcggaagctgtgcgtgatgaagctcttcagcaagaagcgcgcggtgtcgtgggcctccgtgcgcgaggaagtcgacgcggccgtccgcgccgtcacggacggcgccggcgccgccgtcaacctcggcgaactcatgttcaacctcaccaagaacatcaccttccgggcggcgttcgggacgcagagccacgagaaccaggaggagttcatcgccatacttcaggagttctccttgctgtttggggcgttcaacatcggcgacttcatcccgtgggtgagctggatggacctgcaaggcatcaacaagaggttcaaggtggcacgagaagcactcgacggcttcatcgacaagatcatcgaggagcacatggccaaccccaaggaagctgacgcagaggattccgacatggttgacgagatgctcgccttcttcgaggagtcccgcgaccgcacgaaggaaaacgaggcagatgagctccagagaacgctcaggttgaccaggaacaacatcaaggccataatcatggtatgtgtccatgcataaatatgaacaacactacatctaatttatgggaggaacatttcatgaacttatccgtatcaaacttgtgatcggttcatcctttgcttcaatcactcacttctcaaccaagaacacatgcggctgttcgacttggaatcgatagactgattgctgaagtgcacaggatgtgatgtttggcggcacggagacggtggcgtccgccatcgagtgggccatggcggagctcatgaagaacccagaggacatgaggcgagtgcaagaggagctggccagcgtcgtcgggctgcaccggaaggtgcgcgagagcgacctcgacaagctcccccacctcaagtgcgccgtgaaggagacgctccgcctccacccccccatccccatcctcctccacgagaccgccgaggactgccaactcaccggctacgccgtccccgctcgctcccgcatcatgatcaacgtgtgggccatcggccgcgacaaatcagcatgggaggacgcggaagtgttccggccgtcgaggttcgcccccggcggcgaggcggccgcgctcgacttcaagggcggctgcttcgagttcctgcccttcgggtcggggcggcggtcgtgcccgggcatgcagctggggcttcacgcgctggagctcgcggtggctcagctgactcactgcttcagctgggagctgcccgacggaatgaagcccggcgagctcgacatgggggacatgttcgggctcacagcgccgagggcggtgcggctggtggccgtccctacgccacgactcacctgtccactgtactgatggatcaccccgtccatccatgttcatcatttccagtgtttccggaagaaccaagacaggattcgtacgcatgccatgtctgtgtgggagattgcttcttggtcaacatggaatccatgttgcaggcagcagaaataaagatgtatgattgtgtctcatgtgttttggtggaacaagcagtgtgtctcatatatgttatctgtctcatgtcaaataaatagactttaaggcactattattcttaagtcaagcttttttttgttatattttgttgaatatttaatttatagattattttaccaacaaaatataaaacatatgtagtgctacatatccgattacatttcacatctctcagtccaaaaggagaaaagcttagacatctttcgaagaagatttgcactgtaatcgctgctgtgtgattgtgatggacatgtacaagcgtgccatcagcaacagaggaggagcaggcggatgtcaaagaatggccaagttttgggaatggcttaggacagtacgaatctgcttctgctctttcggcaaaggtgggcgccggcggcggcgacccgggttcggacgcgctcgaactctgcggcggggcaggggatggtgatgccgccggggtggtggaatccgaactcctcctccgcctcctgcagcagctccccgaacaaggggtggttgaagtagatcaccggaaccacgtacctccgcccacgtacaccgcgatgtgccccttgggcggccgcctctgctcctccaggagcggagcccggtcgccgaggtggggtctgcgtcgtaggaggcggcagatgctccggccccagtgggcgagcctcgtggtagccgtggagctctccatcaagggccgggtgtggtcacgacgtcggccgagccgcgagacgcatcgccatatcctcgagagacggcggcccaacctgaaccctcctttgtgtctcttcataatatggagaaggtgcatcaaaacacacccattccttctctttatgcactgcacgagagatccaagaagagagagtccgatgaagaggtcagagagaggaacagtgaagggagaaagagagatggcggaatgaatataaagagggctggtcaacggtattatatatgtatatatatacatatcaattgggaattgagtacggaagaaacagaagaaggcggcggcaagaggagacgtgagagtatggagatgtgaaccgtgagttggctgcaccgtagaacacacggcctgatgagctacacaagcgtcgcgtggcggagaagagtgtggtgtaaacgcaaacgcaagtggtggtgagaatcccatgacaaagacttcacatttgttctaccaattgtctccgttctccatcgcacgctgatttgaatggggaattggagtgggaagaagcatacttttcttgtgtgcatgtataacatgttcactcggtgaaagggaagcgaagaagaagaagaagaatcaaagaagttgctcgttggactttaaaaccatgtcgactgtcagtaatgttgattattatgtatgcgtcgacgactcattccccacttaaatgtatgcaaccatcggtagctgagaaaggagaaaggataagtgcactgcttgtggcagtggcgaagggatcgatggtgagatgagcacctcctctcatctaattcggaattagaagagtactgcaccgggatggccggagctcgttactcttttgtggtcaatcaactaattgttgatgatgtgtacttacttccatagatttgagtttaaagtctatacacatacttcgataataattagtattatttacatagtgtagttaatcaagtagaacattatatcacaagatcgatattttaggtgcaaattttatagagtgagattttgatgactcaatataaaataagtgagtcaaagataccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 91 - DNA, 6104 bp, Musa acuminata
  source 1..6104: /organism="Musa acuminata" /mol_type="unassigned DNA"
aaccaaactacatacacattgttgacacttttttttatcattgatagatcactcatcaggtgcagtatgccttgtagatataatatttctactttgtcagcattgtttattctgatatagctagtgatatggtcatattcacttccatattgattggaaagttggaaaaccaagtcctagtaagagtgagcccaaaatatgattcctctcttagagacgcccgtgcaggacactgtcgatgcatgctagttttctgtccatataaaattaaagtcctgtggatgaatcataaaggtcacctgtcatatggccatgggttttcagtttctgtttctagaatttgtagtacaaaacaaaaacctgtaactttcgagcatgtttcctatcatcattcttttagtttttttttttccttttcaacaacaaaaggtaagagtctggtgcttgttagaaagtacggcatgcgcatctgccctctttcatatttttgaagtttaaatttaaatgctgtcgagcgatgtcccgtcatttattaccatttgatctgatttttgacttacaggtgtcagataatggctgggctgaaggtgaatgcaaaggaaaagcaggttggttcccttgcgcatacattgagaagagggagcgtgtgcttgcaagtaaaattgcttcaatgctatagaagtgttgctttgcacgaagtgtgcatgttgcagtgttgggcttccataagccgaaatatcgtgtttgtgtctatggtgtttgtatcttcaacttatttcttgcattttcccccatcttacggtttgtttaaatggccaatgctgtctgatatctttgtcaaaggttaaagtagattttgcaggaaaacaaagttatttagtaatccaccacttaaattactggctttgattaatataactactgtggaatatgctgctggctgcagccaaataagatatgccacgttgcaagctattggagctctaaattgagtgctaccggtgccaatggtcctcttggtcggatgcagtggacatataaccagagataatttgtagttttctgagccaggtttttctttatgttctttacattttttgcttgctttttcgtctctctctctctctctctctctctctctctctctctctctctctcatgatatatgtgtgactcgtttccaaatgtattttgagttacagtcacagtcccgtattattctagttacattgcatacaagatgatggtttaaccttgaaagtctaactcattaatcttcatttgaatccaatgacacgtaggttttgccaggatctcagtctcttccccttggaggaagtcttgcagcaagaggcagaacgaaggaatagttccaagaggtaatgttgtcgaagattctttcctttttgatttgcgatggcaaatatatcatttcatttcactaccactgagctgttgctgcctgcgacaactactaggctccgttatttattgaggtgcgtgcgccagtgggctcattaatagtataaggatatccatgctttcagaattgcttcgtgtcgtggctcagttatcattatctttcttcattttttattgtctttgtccatgctttcagaattgcttcacgtggtgatggctcagatatcattttctttctttatctttttttttcttttcatttttttattgtctttgtccatgctttcagaattgcttcacgtggtgatggctcagatatcattttctttctttatctttttttttcttttcatttttttattgtctttgtccatgctttcagagttgcttcatgtgatgatggctcagatatcattttctttcttttttttctttttttttattgtctttgtccatgctttaagaattgccatatcattttcttcctttttttttcttttcattttttttaaattgtttttgtccattctttgagaatcgattcatgtcgtcgttgctccgatatcattatctcaatacatttatcgaagtaaaaaaagaagctatgagctgattgaatcaccttggcgttttcccaagggttgaggtgggcgtgtcactaacctgatttgtggaacccgttcgttgggttccatcacgtgcctccaatgtcatgtcggtgaaagcccacatcgaccatcattctataaatctgcactcactccctctaacggtgacacaactttcatcagcacagtatggtatgggtcgaagaagtcacctccatgcacttgattctactatgtttgatgttacctttgacactcctacttattgtcaacattgccgcaaggaggcggcggaggcttcccttaccgccggggccaactccactacccatcataggtaacatgttactgatgaaccaactcacccaccgcggcctcgccaggctcgccaaactctatggcggcctcctccaccttcgccttggctttgtccaccacttcgtggtgtccacgccggacgtcgcccgacaagtcctccaagtgcaagacagcgtcttctccgaccgcccggccaccaccgccatcgtctacctcacctacaaccgctccgacctggccttcgcccagtgcggcccctactggcgccagatgcgcaagctctgcgtcacgaagctcttcagccggaaacacgcggagtcgtggctctccatccctgaggaggtcgatgcggccgtctgcaccgtcgccaagcacgccggctctgctttcaacgtccgcgacctcgcgttcactctcaccaagaacatcgtcttccggtcggcgtttgggaagcggagcgacgagaaccaggaggagtacatcgccgtcgtccaggagatcgccacactcttgggagccttcagcgtgggcgacttcatcccatggcttagctggatggatccgcagggcatcaacaagaggctgagggtggcacgagcgacactcgacctcttcatcgacaggatcatcgatgagcacatggcgaccgacgccgccaacgcagacatggtgggcgtcatgctcgcattcctcgaggagtcttctcaccaccaccgacaagaagagggagatgatctcaagggaacgctcaggctgtcgagggccaacattagggctgtaatgatggtacgtatacatacgctctaaaaagtaatactatttcctcattctctgttactgtaacctgctaagctatatatttatctccacattgatatggtttccatgtgcttcgttaatatctcgttgcgtaattaagacgattaaattctcatttttctaacctgtaaaccgtatcatctctaattacgcaggacgtgatgtttggcggcacggagacggtggccatcgccatcgagtgggccttggccgatctacttaccagccctgatgacctgaaacgagtgcaagaagaactagccatggttgtaggactcgaccggaaggtccacgagagccatctcgacaagctctccttcctcaaatgcgccataaaggagacgctacgtctccatcccccgttccctctcctcctccaccagactgccgaccactgcgaggtcgccggctactccattcctgctcggtcgccagtcatgatcaacgtatgggccatcggccgcgacgagtcggcatggaaggacgccgacgcatatcgaccgtcacgattcgctcccggcggcgacgcggccgctctggacttcaaaggcaactgcttcgagttcttgcccttcgggtccggccggcggtcctgcccgggcatgcagctgggcatgcacgagctggaactcgcggtggcgcagctgctgcactgcttcacctgggcgctgcccgacggcatgaagccaaccgagctcgacatgggggacgtgttcgggctgtcggcaccgaaggcggtgccgctcgtggccgtccccacaccccgactcagttgcccactgaattgatcgtctctttcttggatttggtttccacgaaataatgaaataaagaagcgggatttcggtagctttccactgtacacaccattaagcttccctctgttcgcagtgtttcatatatgcaataaatgaagagcttcagctctttcctgtaataccctcttcatcagctgccaagagttacataatggtgatcgccattagagatataactcatacagacatttatcgttatcatataatggtgagatcagaaatgttgtcttcgctcctgttgtggggaacaaccttaagccatggcctcggggccaacgtggctgggttcggatccgaatgatcggggatcttgctgagcgacccttgagactagtgaggtgaccgactgcagtggtccgattacgacaggacggtcgtttcctctggaaggaaactcctcgcctgggtacgcgatgggaggtgcttcgtcttcgtccctgcacacaggtcgggtcgggaggctcgacttgaccctccgacgatcaagtcagtggatagtcttagggggtttttctcatcttttttcccccttccttgagctgaatgcgagggtttttatagggaagcttattgtctcatgatgtgcccacacttgcagggggcaggcccgtactttcgatagcgtctgacaccaatgtaggcgttgcatgaagaaccaggcttgcgcaggacgtggcgtgccctgatcgtcatcctggtctgcctcggtcaggcgcgtcaagtcaaatcgaggcatggatcattatcttggaggagctgatgtcaacgcacgtcccatcgttattaccactatcaactcctatccaacaaaataattaaaattatatattcattcgggatctttggttattattataaattaagctttaaattcatgaaaagacggatgtaattttggtcaaccacaaatgcaatcatataatcttgttttgtctatatttctccactattaaccgtcatgatcttattatttcgtatttgcatattaattaattaattaatttatttattttcttgacacccaaaaataaacgctaagaggcgacaaagctgacgtgtgatgcgatcggagaacggtataagcaaggggggcaagaagtggtgcgttatggtccggcatctattgccacccagtctccttccgagaccgcgccgccccggttgatcgccatcgccaccagcgagatcaagaacttgcacggcggggccccggccgcgatggccccgtcgttgctgaacccgacgcatcggtacgcggcgggcgctctgctggccctcgccctccgccaggcccagatccaccagacccgccccctcggctacgacgaccccgaccccgacgcacagggccgctgcagcaccggaagcgccaccagcagcgagggcggtggcgacgaccccgagctctggacccacgagtcgtgcggccttctccgccccgtcttcaggtccccctctcgttctctcctctccttcctttcgaaaaaccgtttccgagtcttcctttattctttcttctttggggaaataggttcttggatatagaccccaaagcctggtcgggcttggaggagactgcggcgtcctccatggccaagcatcacataggagcggtacactcgatttccttttgactccgttgattgttctcttggtcgaattgctttctttatgggcgatcgtcgtgataatcgtagaaactgcttattagcttgcactacttgtgagttgtgatggtaattctagcaagaatggtcggacatgctttctctgtgggtgatctagtgattatgggagaatctgcttaatcttgccctagtttctggttcttgtgagtcgttaaggtaatgatcgcccgggaggatccaacttgtttgcactgtaggtggtcatggtgataatggaagaatatgttagcttgcctgcccccatctttggtacttgtgagttgtgatggtaatgatagccaagaattgtccgacttcgtttctctctgggctgtcatggtgataatgtaagaatctgtgtcaagacctgtcatggtagccaagaagggtctgacttgctttctttataggctatcctaaccatattgtaagaatacgggtctgaccgttcg

SEQ ID NO: 92 - DNA, 9140 bp, Musa acuminata
  source 1..9140: /organism="Musa acuminata" /mol_type="unassigned DNA"
  misc_feature 1622..1711: /note="n = a or t or c or g"
  misc_feature 3688..4043: /note="n = a or t or c or g"
  misc_feature 5860..5879: /note="n = a or t or c or g"
acgagggggaggggcggtactacgtggtgatcggaggagttgccgggaacccgggaaaagagacgctgagcaactggttcaagatagagagctaccaaggagtctataagctggtgttttgcccgacggtgtgtgattattgcagacctgtgtgtggatctctgggtgtctacgaacaaggtggaagacagtggctcggtatcagggatgacacgccattcccgttcgagttcaagagggcatgagcttcggtacgtgaatacatctactgtcatacatctatatatcaataaaggaggcattgtcttcggttgatggtggaggcttgcatgctttgtttgagtccccgcgtgtgtgggtatgggtgtggtggattggcattctcaaactctttgtgccacactcccatgaatcataggttaccctcaaacataggagaatgaatctctctatcaacatgagtgactcttttcatgctgtgcaaaaggataataagttatagattctgtctcattaggatatatatatttctattattatgatatttaacttttttataatgatgaaattattaaataaaattaaattagctaatggtgggttaccaccagactttttcttacaatgtattcctgacaaaatgaatttttgtccattttctttttagaggtctaatagaaaacaaaaaaaaaaggtgtggaagaaaataaaaaataaacatgggttgagttgtgcggaagagatagatctcgcggagagttaattacatattacctctaactatcttatctttagcttctcgatctatattcttataagaattatattagggtttctatatctacaaaagtaaattattgagatccttatattgggttagaaataaaagaattttattgaatcaacatgattaatataatatatcaatgtaatttttgaaagtataaggatcaaaatactaggataggatgacaatggatagagaaacattagacagggttaccgatcaatagggagtaaaatgattgaaatgggactcaacaattgaaatatttcatgggtcccacccaccacgcaaatactgcacgtgtagagagcatacttgtctcccgccgatgtgatggtgttcaccgtctcacatcgaatcaaaggatgattctaacaaagttgttcgttttgtgcttaaaaaaaaaaaaacaaatcagttctttgttaataaaattaaggtaacaaagatatgaaatcaaaataaaaatattattatggacactgtcacatctgattaatggaaaaatcttatgttatggtggtatgagattcgcatatcatgtagcttttttatttccaagtgataaattctctcagcttttattatttattctttttggaggtttccttgttaattttattattttacatatcaaagacgatcaactctttggaatgtaaaataataatgagttagttagggcattttagtatattatatatatatatatatgtatatatgtatatatgtatatatgtatatatatatacatatatatacatatatacatatatatacatatatatatatatgtatatatatatatatgtatatgtatatatatatatatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatatatatatatatatataactgtgcgttttcgaaattacttaacgtatatatacttgtagtgaacaaaaatctgatcacccttatacgagagccgttcattctagttaccttttaatctcgatcgttcaggttttcccagaaaaaataaatataaaaagaatatgactcgatcatatcagctggacggccccccctttgggtcactataaggagcgccctccggccactccgggtcctgccgacaccgctgtctgtcggtcttcggtgtcctcagctagaagaggagccatggattggtttcaccaactctcgttcatggttgcttccgttttcatcccactcgctctcttatcgttcttctgcatgagaagcggacgaaagcttctgctgccgccagggccgcagccgctaccgattatcggcaacatgctcatgatggaccagctgactcaccgcggcctcgcgaggcttgccgagagatacggcggcctcttccacctccgcctcggctcccttcacgccgtcgtcgtgtccacgccggagatggcccggctggtgctgcaggtgcaggacgcgtcgttctgcaaccgccccgtcaccgccgccatcgcgtacctcacctacgaccgtgccgacatggccttcgccaactacggtcccttctggcgccagacgcgcaagctctgcgtcatgaagctcttcagccgcaggcgcctccagtcgtgggcgtcggtccgccaggaggtcgactctgccgtccgcttcgccgctagacggagcgggtcgtccgtcgatgtcggcgatctggccttcaccctcgccaagaacgtcaccttcatggcagctttcggggcgcagagtcacgggaaccagggcgagttcgccggcatactgcaggagtactcgaagctttttggggagttcaacatcagcgacttcctcccatggctgcggtggatggacttgcagggcatcgacaagaggctgaaagtggcaaggcaagcgatcgatcgctacatcgacgtgatcatcgacgaccatttggccaacccgaaggaggcggatgcgcaggacgccgacatggttgacggcatgcttgcatttcttggggattctggtgacactaacgagggtggcgatctccatggtgatctaagcctcacaagatctaacatcaaggcgataataatggtacctctctctctctctctctctctctctctctctgacagctctgccgtcaattataatgcctttgctagtattagaatctcaacatagattgaggatatatatgtagacgaatacacgtttgaactcagagatcagattttagtttgagtaattctgtggcatgtcagtcgcaatcatgtcttacatgtcgtcttcagagatggagacatcctcttcggctggatgttggcattatcttatgcaagcaggcaacaaagccagcttgaaaaagtcattgaaattgttgtatttgttggggtaaacaactttatgccgtggtctcgggaccgacgtggcttggtttgggtcggaatgcgcggggatagccggggtggccagttgcgatggtccaggcgggacgttgcgtgtggagtgaagcttttccgcagtgccgggaagatgcaaccccgcccttgtacctgcacacaggtcgggtcggaagctcggctcgacccctccgacgatcaagttagatgatgtggagggagttttttagtgaagaagtgtccccccctcctcgtttagaactcgggggtatttatagggcagtttagtattacctgatgtgcctgcctgcacgagacaggatcgtacctctgatggcgtctgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgggcaagccgtcctgaggtttgctcggcagtctgtggccgaggagctcggcgcaggcgggctgcggccaagggatgcaactcaggtgggcaagccgccctgaggggggctcggctgtccatggccgagccgtgtagattaagaagattttaagccacgagccgagagggggtcaggtagatactggaccttggctcgaaaagggctgaggcagggcttggatttcttttcatgaagactacatggggtagccaccgcgggtgctctaactctgttacggagcccgcggtcgggggccgttgcttctcctcatggccgcccaggcttccgccgcgatgtgccggttagcgcgctggagcatctctggcaccgtcgtgggaggttgctccgcgagtgaacagaggaatctggaaggtcgcaggccgatcatgaacgcctgcactaatagagaggagtgagtgtccggcaggccccggatttgcgtggcaaagcaatccacaaaatgggagaggggctcatcctccccttgtttgagtccgaggagtggtgccgcggaaggcttcggccgtacataggccacaaagtggagctcgaagttcttggcgagccgatcgaaggaagcgatggtcccggtcttcaggccactgtaccacgcgcgggctggaccccacaaagttgttgggaacgctctgcacatcaaggcgtcagaagtcccatatagcgccatctgggcgcgaaaagtggctacatgattcgctgggtcagcggtgccgtcgtaggcgtccagcgaagggagtcggaaatgcgatggaatcacttgatcttgtatttcgggcgcgaacggggacccttggtgtccgtccgctccgagctctccttttgacctgcgaacctcctgctgtacttcgtcgaggcgtcgactaacgaggcgcaactgggctcgcagggcgttcgtcgagtccgcggatagcgcctcaagctctgggcgactcgacgtgtcttccgcctctcggttcccgggctgggctgttcggttccgaggtgaagcagggagctcgggaagtggtgcatgagtctgggtggggggctcccgctgctgcagaggctgggttatatgcggggtcgtcggttgggagacgagcgggatgatagtttgtaccacgcccgccagtgctcggacttgatgagtgaggtcgtggaaggcttcgggcgatacaggcgacgggccgacggggtcgtcgggtggcgacaaacccgggtcgttgaacaaccgccagtagcgctccgatgtcgtggcagggcgttcgtctcggggttcatcacgcatgggatgttcttctagggtgttgatcggacgtgaccccatggctgcgggttcgccagagtggatctactgatcgctcgacattcggggccctccttctagcgccaaaatgttggggtaaacaactttatgtcatggccttggggccgacgcggcttggttgggtccgaatgtgcggggatcttgcgcggcgttcctcgggacagccggggtggccggttgcgatggtccgggcgggacgttgcatgtggagtgaagcttttccgtagcaccgggaagatgcaaccccgcccttgtacctgcacacaggtcgggtcggaagctcggttcgacccctccgacgattaagttagatgatgtggagggagttttctagtgaagaagtgtccccccctcctcgtttagaactcgggggtatttatagggcagtttagtattacctgatgtgcctgcctgcaggagacaagatcgtacctctgatggcgtctgatnnnnnnnnnnnnnnnnnnnnatcgcccttgtcgttgcgtggagaaccgagctgccgtagggtatgggcgtgcctcggtggtcgttcttctctgcctcggtcaagcgcgttgggtcaggcaacgatgaagtcttcatctgagagcgggtgacatcagcgcccatcgtgtcggcattattgccctctttcgggcagagtgtcgtccagccatgactgacgtcgtggcgcgtcatgtcgctattattaccctcgtcagtattgatctatacgtccaaacacatggaaatataaactgttggaggtcgcactctaacgtggccttcgttggcatatatggctgcatgcctacgtatcttttttctttcttcctcgcagcgttttaaacgacaaagaacgataaaatagtcgaattcccttcaaattacatgaaattgaaatagtatcgttgtgttcgcatatattttttgcacggatatcatttttgttgcacacatacaaagcatctgaggattatactaaggtcgtactgcttctatatgcattcatatgaggattgcaatctgtacgtgacacacacacaggatgtgatgtttggtgggacggagacggtggcgttgggcatagagtgggccatggcggagctactcaagagccccgaagagctgaaacgaacgcaacaggaactggcgagcgtcgtcggcctccaccggaaagtggacgacagtgaccttgacaagctcccctacctcaagtgtgccgtgaaggagatgctccgtctccaccctcccctccccctcctccaacaccaggctactcaggactgcgagctcgccgggtacttcatccccgtcgggacaagggtgttcgtcaacgcgtggggcatcggccgggaccgggacgcgtggaagagccccaacgcgttccggccgtcacggttcgccctgggaggcgacgccgcggcgttcgacttccgagggagctgcttcgagcttctgccgttcgggtcggggcggcggtcctgcccgggcatgcagctggggctctacgtgctggagctggcggtggcacagctgctgcattgcttcgactggagcctgcctgccggaacgaagcccggtgacttggacatgggcgatgtgtttgggctcactgcgcccaaagcagtaaggctgatggctgtcccaactccgcgcctcacttgcccgctcctataagaagcttgcttctctcccgcgcggcactctcgttataattgagatattgttcctcgttaattggcctatgaacatgcagctgaaacatctcaattgtgcctttgttatgcaactattaagcttttactccttgatatataaatccaaccgcttacaataacgaaacatttgccagagaacaacatgaggagcaagtgcagaacctgtatattcccatgtttgcaccgaacttaccataagagttgttgaaatcacaaaagattaatgaccctggcgcaaactctatattaacacaaaagatctggtacatgcatgccaccagtatgaagatgacaagatttccggggagtcaagtctgggccaatgggcataattggttaatttgttttgcagcagaccagagtcttggatgttgttggtcatctttaaacataatcaaattcgcatcggttcccagtatcccctggctgatcaacgttgctttttcaacatcaaacagtgatatcttcctcgtcccctgtccaggtgtagcgattgtcttcccacctacaaaacaaggtctatatatacggtaacaagttccagtgttggattctacatgaccttgaagttggctgtgaactggtccagcagcgtttctgatgtcgtagagatgcaatatcgggtcactaccggctgataggatcaggaaattgttccatttgttccattcaaccgtgttgacaccagtagagtgcagtgatttgatggtaagagcacaaggctccggcgaccttggatcgaggacacatatacgtccatcgactccacagtcggcaagtcgttcttttccatccctgcaaaaatattcaggaacaacatatcggtactctgaagcactgaaaaatacatggcaattcattttcgtaaagcaaatcattgtgttgaaaattataatgctctagagttgaaaatattgttatgatattctatttagattattccgactctcaatttaaagtttgtttgcagctacactcaatgcatagttaaattcagaaatacatgtgcacaagatgggtcaacagaacattgcttctatatttgcatgttctataaaccattcctccgtaaatttcgccagtcactagcagcaaacttcatcctcaagaaagttccagtcattaaaagatgaccagtttggtatataagtcggcgacgttatgaaccaagaggtcgttgtcttctattgacaagtcacttggtatgtccttgtagaactacacaagaaccttgatgctattgagtgaattccaagttcatgaacaatagcaagattacaacagttgagctggaaactcatcagctaccggctttcagaaatgtcatgtagaatacgctacaacccaccttgactgctacacacattattcatccattgcttattccgttatccccttctatgcaattaaggagtgaatttgaagatgagtgtcattgactcagaaagaaaagacaagaaaatttaagagtcggtcttcgaaaataacagtgctacaacataagatagtatcctctacatttgaatttgtgagagcatcctctttttgtaatgcaagttttgggtttcgggagccgcctcatagatcataacaagttgataactagtttatttttctttaatgaaccgattgagttgatgatatgcgatacttatgataaacacattatcgatctatattttctaccacaaattgtaaataaagaatcaggatttcaagagttcactttcatactatcaggaaaaaaaaactaattctaagatttaaatatctaaatcatgaattaagaccggaaatctccttcagagaaggtggcatggaaaccaattcaccaacgaaaaccagacatatcttaaattgaagaatgatgactattgtgcatcaaagagttaagtaatagaagggttacccaaaacaaacgcccctgatgactcctgaatggtggccggtaatgttccgctctgccaccagctcccctgccggcgtcagcctcgaaacaccaacagaggagtcctttgatgccgtgg

SEQ ID NO: 93 - DNA, 5925 bp, Triticum aestivum
  source 1..5925: /organism="Triticum aestivum" /mol_type="unassigned DNA"
  misc_feature 460..475: /note="n = a or t or c or g"
  misc_feature 4207..4216: /note="n = a or t or c or g"
cctggttgtgtgggggtcacactgcctcataaccaagcaaccagtggttgcttctcagaaatggattattttatcgatgtgtagagttgatagaatggtataagatccgtccactacatcaacacattgaaagtacatagaggatgcacacaaccattatactcacaaagctaaattgagacaagaaagggccatgaaggaaaaggacaaaccattgacctcatggttacaaccacccacccatgttcatgtcatgtctaaactattcgatccacaaccaaagaaagatgaaatgcaagtcgagctgatgaaaatgtccgcactcaaaacctttactcatcaccaatgaagacatgaacgtctaaaactcggaaatgattactccaaggccatagcctgaaccagagatggaacccggtaccgagataatacccgaaagcacggggtggtgtgggggggnnnnnnnnnnnnnnnngggggggggggggaggggggttcgcacctccatttttctgttggtatgggtttcgtgggaagaataaatgaactttacaatccactcaatgaaacctcttttaaagatttctttcacgcagaataaggcaaaaaccataagaagtttaaatatcaacctaatcttacctgtgttttattgttaattttttttgaacagttttaatgttaatttgagtatgtatttttttattcataagttttcctttaatataaatcaaacaaacaattctgcagaactcactatgtccacaattttgttgcccatacaatcctatccgtgttttaaaaattccgcaaattatagaggccctttaaaggggtatgtgcgacaattccctgctgccaccgaatgctagaatgatccagagaatcccagcaaacacagtagatgccacaaacaccaccatcccctacaacgtcaccccatgaggttgttgagatctgatttccgcgtgcagccgtggcatcaatccaatggcacagagccccgttgaaacctaagtttaatgtccacatgttcacgtgctataaaacaattaacatacactgcttgtgacagcttactaattgaaaggtgcttagctagaaatcctcaatacactgcttgcgttatagcttactaatttaagtcgcttagcttgaaatccccaattattgggagcactacacaagctatatatgctgactggacatatatataccctcccccgtaccaccaactccatttaaaaaaaaatgctaacaactccacccaagaaactaaaaaaaacttaaaagaaccctcaactactcatctaaggcatcaaagaatatatcatgcacaccttcttttatgaattataaattgcattattattttgttttaaaaagtcatagatttagatgttttaacatatctcacttaggttatttttatgaaatcaacaaaagcatctgttgattattcttggtccaggctcatgtgagggtaaggctcccaagcacggaaatagccaatttaaggttcttaaggtttatcaagaaaaatattattttcaataggtactttgcgtaaatacagcaggagaatactactttatgttggatctagtgatattgatttgatagcgtgcatgttgatatttttcttgataaccagagtcaaacttaaaaatcaagtaagccttgtataaatccatctggagggagtattaattatttgatgcaaaaacagaaacactagtgatagttcacgtgtgatgcgcagggcgtgcaagtggaataaaagaaaacacctcacccacaagaaaaaagaaaagaaatccttttctaaaaaaataaaaaagaaaaggaaatagtcggcctcgtgtgcaattgctatcatgcggtgtgacgctactgtttttcaactacagtagcacagtatatataaaggccccatgcatccacagggattacagcggagtttcttgtttgaagctagtgctcgatcgttcttattgccaatggcgacctttgcaaagatcgccatggagctcctcgcggatccactgatgtggctgttcctcgcctcgctggccttggtagccatgcagaggcggcggctgggcagcgcgccgtttcctccgggccccaagccgctgccggtcatcggcaacatgacgctggtggaccagctgacccaccgcggcctggctgcgttagcgaaacagttcggcgggctgctgcaccttcgcttcggctggctccacgtcttggcggtgtcgacgcccgagtacgcgcgcgaggtgctgcacgcgcaggacggcgtcttctcgaaccgcccggcgaccatcgccgtggtctacctcacctacggccgctccgacatggcgttcgcgcacaatggcgcctactggcggcagatgcgcaagctctgcgtcacaaagatcttcagccgccgccgcgcggagacgtggctcgccgtgcgcgaagggtacggggcgctagcccgcgaagtcggccggcgcagcggcgaggccgtcaacctcggcgagctcatcttcaacctcaccgtcagtgtcatcttccgcgccgccttcagcacctgcgacgaggacgggctcatcgagttcatcgccatcctccaggagttctccaggctcctaggattgttccacatcggtgacttcttcccgtggctcgcctgggtgggccgtcgtggcttcaaccgccggcttagcacggcgcgcggcgctctcgacaggtttatcgacaagatcgtcgacgagcacatgaggaggggcaaggacccggcagaccccgacgccgacttggtagatggcctgctcggcttcctcgctgacgcaaacccagtcagcggcaagcgcagagaggacgctctccgcttcacgcgggataacgtcaaagctatgatcatggtacgcgagtaatttgctgtactggtatactctccctgttcacacatctcaagaacttcacttggtacattttttttattactgtgtactactaatacatttttttttgcgagggagtactactaatactaatgaactaaaagcatggcaagtattttggaaccaagggagtacaatttttttaagatagctaacgtctatccatcatatgaaatgttaaaaagaaattccacacccacaaaaaaaatccacacatattaaaaaaagttccatttgttcagtttatcattctactggtatatgacttcctgaaagagaaggaatattatttcctacaatatattgtggtgacgtggctatcttcatacggcatataggacatgttatttggtggaccggagacggtggggtccaccaccgagtgggcgatggcagagatgatgcgtagcccagatgagctcgagcggctgcagcaggagctcgccgatgtggtggggctcgaccgggctgttgaagaatccgacctcgacaagctccctttccttaggtgcgtcgtcaaggaggcgcttcgcatgcacccgcccatcccggtgctcctccacgaggccgccaaggattgtgttgttggcggctactccataccgagaggctcccgcgtgttggtcattgcttgggcgatcaaccgcgactgcggggcctggaaggatggcgacacatttcgaccagcacggtttatacccggcgagggggaggccgccgggctagacctcaagggaagctgctacgagttcttgccgtttgggtctggcaggcgctcatgccctgcgcaggggctcggccaacatgcggttgagttcgcagtcgcgcagctggcgcatggtttcaattggaagctgcctgacggcatgaagccagcagagcttgacatgggcgacatttttggcctcaccgcgtcacgctccacgcggctctacgccgtgcccacgccccggctcacctgccccgtgtaatgtgataattattggacaaggcgtgcagtgcccacagagacgtaatatcatattgccaataatgctacacctacaaacaacctataaatgtttacttaacatttcaaactataattctctgccccctgaatttagcaaagtttgccccgttatcacgttttttgtatgtgacaagcataacatatccgactattgtcattgtgaaccatcatcggagcttgagagagagagagagagagagagagagagagagagagagagagagagagagagagagagagnnnnnnnnnngagagagagagagagagagagagagagagagagagaatcatatttggtcttacaataaatgctggtcttcttgtttattattttgcaatgtttgacttcggctaaaagatataatctttacgtatcaagacaaaatataccattcattagtgtagatatgcctttctcatttagcatgtaagtggcattgcgcacaagtataagagctggctaaagttgggaatgtgatatggaggagttcaagtcataccggaacctaaaatctcctcgacatagattctcaaagaaaaatcttctccacagacaaaattaacatgtgagcgagctataaacctgctattgtatttactctgatacgctgatgacttcgacttggggagcatgaccgcgaccaccacacaatgcccaagacaaaactggtcgattagccaactgggcgtccacatctcctaggcgtgccacatgagcgagctcgtcaggtatatatacatataccataccacactgtcattttggagcatcccccaccacccactggtccagtaaatccagccagttaagcctcctcttcctcctcctcctcctcctcctcctcagtgcactgagtgctggtccagaaaaagaaaatgtgcttcgagttcagcttgtgcttcggcggctttagagatgactacaacggcgatcggtccaaccacaacaagtccggggactgtcagcgacgccgtagagggaacaacaataggaacgactaccatgcatgtagtaatttttttcacgaatacatgtagagcgtatcaacgcatgtgcatggctgtcgttagctcgtgttgtaaggtgttgggttaagtctcgcaacgaacacatccctcgtgtctagttgccactgtaagtttggaaccctgaacagaccgctggtgttaagccggaggaaggagagaatgaggccaagtcatcatgccccttatgccatgggcgacacacgtgctataatgggcgggacaaagggtcgcgatctcgcgattgtgagctaactccaaaaacccgtcctcggttcggattgcaggctgcaactcgcctgcatgaagcaggaatcgctagtaattgccggtcggccatacggcgatgaatccgttcccgggccttgtacacgccgcccgtcacactatatgagctggtcatgtttgaagccattacccttaactgtagggaagggatgcctagtttgcttccttctattaatgcattgatatgctctgcgtattcgcaaaaaaaaaaaactaaaaaaaaactactatgccgacggcgatagaaggcatcctaccacaacaaacagcccaccgccgtagacgaggccgggcacaaggcctatcatgacggcgctactggccacccggccgtttcgccgccttcaagacaccaaagcttcccagcgttcccgggccgcacaacacggcgcacctccaagaaccagctccaacactgcccaactgccactaccacgaccgctcttggcaggtagtccagattagctatgcggctatacaccactgtaagtaggattcgctagcatgggcatggcagtccagttcatcaatcgctccctctccctaaatactgcatatgcttctgttctatccgtagctctgtttttctcctctgttttttctctcttttcgaattttgatcaagtggaagtgcagtgatgtatg

SEQ ID NO: 94 - DNA, 9466 bp, Triticum aestivum
  source 1..9466: /organism="Triticum aestivum" /mol_type="unassigned DNA"
  misc_feature 356..456: /note="n = a or t or c or g"
  misc_feature 1623..1635: /note="n = a or t or c or g"
  misc_feature 5116..5148: /note="n = a or t or c or g"
cgggataggtggccccacccggtggacccgcgggacccttctggtggtctcggtacaataccgatgacccccgaaactttctcggtggccgaaactggacttcctatatataaatatttacctccggaccactccggaactcctcgtgacatccgggatctcatccgggactccgaagaacattcgggttaccgcatactattatctctacaaccctagcgtcaccgaaccttaagtgtgtagaccctatggtttcgggaaccatgcagacatgaccgagacgactctccggccaataaccaacaacgggatctggatacccatgttggctcccacatgttccacgatgatctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactagtgcacctatacaatttaccattgtattgggtgtgttggggacacaagagactctttgttatttggccgcagggttgtttgagagagaccatcttcatcctacgcctcccacggattgataaaccttgggtcatccacttgagggaaattttctattgtcataaaaaaactctatgcttggaggcccaacacgagtctacaagaagaaggttgtgtagtagacatcaggaggcgcgatgatagaacgtctctactgtgtctgagccaccccgacgatgagtgcttgaccgtcgcgcgtcaacatcatcctcggaccgactatgatttgcatgcatgtagcctatgcggcacctgtggtggctacaatgaggccgagacacgccatgcctgtcgcgagaaggcgaaggcggtgttagtgacgtcccgatccaacgacaatccggtcatccgcgtcgtccagcagcgggccctcacctccaaggaatcaaatgcgcgctgccgccgtcaagtcaacaccaaggtcctcgcggatggcatcaatgatttggtccgcgccaccgagaaggtcgcgcatgatgctcagctcacctatgtcgtcccaggccacccccgaactccggcaaccccacgcagggcacctccacagattcctcgtcctccgactatgagatctgtggcgttccagccatccctacattttctttagccgctactaccgtgacaaagacgacaagggcaagggcagtcgtcggtgtgaaactttcattgtcctagtctagtttattgttgtgttttgttgtcatgtgttccagtgttgaacaatgtcctatgttaaactttgttcctatgtgcatgctatgtacatatatgatgatcgaggttgcatttatttgtatgaatttgaggattgaaaaatgagggattcgactacccgaacaaatgaaggttgagtccatgctaccggggacacgtctggacaaatgaggcgccaagatagcccgtcccattgtggttgaagatgatcttacaatccgtaacttctctccttatgtttagcaattttgaaaaagtttacacttttgattatcgaaagtcctacatccacgggctcttatgaagcccctacataaacttccttattaactctatctcccccccccccnnnnnnnnnnnnncaccctaatttaacgagggtgggccctagcccctgatccgggtccaattaattactttcacgtcaatttttatgtaaaattctcacgtaaatttttgtaggtgtaacattattctttgactattcacttgtgagacctagggggaggggctcgaaagttgaacaaatatatagtatcaagtgacataggattaaaaactaaaagaaaaaactaaaaaaatattacgccagtctccatgcaagatctcacgaatataatatcgactaagacataacaaagtcttagtcgactgaaatttagcaacactgatgaatatataaaccatgcatccacacggatagctgtggagggctcttgcagtattactattatcgctatccagctcgtgagtcgtggctatcgtcaatggcggcctatgcaaaggtcggcacggagtttctcaaggatccactgatctggttgttcctcgcctcgctggctttcgtcattctgcagaggcggcggctgggcagcgcgccatttcctccgggcccgaagccgctgccggtcatcggcaacatggcgttggtggaccagctgacacaccgcggcctagcggcgctagcgaagcagtacggcgggctgctgcaccttcgcctcggcaggctccacgtctacgcggtgtcgacgccggagtacgcgcgcgaggtgctgcacgtgcaggacgccgccctctcgaaccgcccggccaccatcgccgtcgtctacctcacctacggccgctccgacatggcgttcgcgcacaacggcgcctactggcggcagatgcgcaagctctgcgtcaccaagatcttcagccgacgccgcgccgagacgtggctcgctgtgcgcgaggggtacggggcgctggcctgcgccgttagcaggcgctgtggcgaggccgtcaacctcggcgagctcatcttcaacctcaccgtcagtgtcatcttccgcgccgccttcagcacccgcgacgaggatgggctggatgagttcatcgccattctccaggagttctcaagcctcctaggattgttccacatcggtgacttcttcccgtggctcggctgggtgggccggcggggcttcaaccgccgcctccgcacggcgcgcggcgctctcgacaagtttatcgacaggatcatcgacgagcacatgaagaggggaaagaacgccgccgaccccgaagctgacttggtagacggcctgctcgcgtttctcgccgaggcaaacccaatcagcgggaagcacagagaggacgccctccgcttcacccgcgataacgccaaggccatgattatggtacgtaactggtactgtatttaccatcttacagtctttactctttactgtatatccatggcggtgtgctcctgctccacactagttctactgacggacggcttgatctgcagagtagtatgaccaatatcctacgacagaaacctcgtacatgtaggctagcacctctctttctttttgacgtgtttgctatttgtaattgtaagttgcttgataatgacaaaaacgagatcggtcgattttccttaatgaagaaaggcgaggcggcgccgagctccaaggcggagaggggggcgacgaggccagtgtcctgagtaagagtaagagcatctacagccgtacgcctcaaatcatcccacataagcccgcggacacgcccggccagtgaccggaagggagagagaagaaaaaacgtgacccaatcggatccctcgtaccatccctatatgcccgggctgtccgcgaaccctcatatccatctcaaatatggggaggatatgagggctcgcggacgcgcccgagcgcgttcgggcattctgccacgtaggactcggccccacaccagaccacctttttttctttattcattcttttatttctctctcttcatctccaccgatcacgtgcaagtgaccggagaagaaaaataaggagtgtggctgcgcggacgaataaatgggggctcaaaacggacacgcccggccactggccggacatgtccacgggtgtttaaggggtcatatttgctatgtccagctgtagatactctcagaaaaagccattaactagcgggagacggggatgcagcgagtgggagccttgacggttggtggtgtggagttggcacccgggatcagagaagaagggtggtggagggttagaggggtagcaggggtggcttgggcacggaggcgaggcgcgtgaggcagtggcgccagctgtaggtgacgagggctgatggtctggcggatgtcagacgggcggctcggcgcaaggaggaagggaagggagtgctaaaaaatgcacgatcccttttttcaactcactggtccttttctttctatcctcgttatttttagtttctttttttacttttgtatttcggtcaattgactttctactacgtggttttgatacctaattattatctattatttaggtaatatactctggcttggatggtggttttttgcttgttgctgatttcttgttttattataattattttccctcttattgtttttgtttttatttttggtttgttgctagtttcatcaagtgcatatacgtatttagatgtccttttgtgtcttttcttcacaaaaaagtgtatatacgtattttagtgttttttacatttcaaagtaacggagtcgcagtagacatgtacctttgatctttagagtataagtattaatagtattacgacaaatacaaatacacttgttcactgaatggtttatggtgaaaggtgagattcatgtaggttgtattttcattgtgtttttggcgcaagatctttgtctagaataagtaaccgtgcattacaattgttttcacatgctatgaaacatgaaaaacatagcaagcaatgctgtaactgaggtttgaaatcacataaatttggtttttatttgatagagacgtgtgtcattgtttgtatggtgcatttttttatttatactgagttggaaatcggtcaacatgatagtgccattcgtcgctgtttgtatggtgcaaaattttgatttgttttttgtagcaaaaatgttgtacggaaccatggttcagccgaagctacgctcgacaccattgatttttaggcactattcataaggatccatgcatggttgattaaaaaatacagctgacatgcatgtctactcatgaggatccatgcatggttgattaaaaaatgcagttgacatgcatgtcacagatccacatgtagtaggatgttaaatcgtatgacatagaccataggttcgattgaaccatggtcctgaatcatgtctctctttttgtagcttgtccttcgtggtacctgctatcgtagccattcatatatgctcagttccatgtggatgtgtgcatcgatggaaaattagcaactggcgttagctctcaaatcttaatctcctgccgctaggactagtagggnnnnnnnnnnnnnnnnnnnnnnnnnnnnnnnnnccccccccacccacagactgagacgtagtgcagacctctctctctttttgcatgcagcgcatctttctctcataaactttacatgcaactctctctttttttctctctttcggtaaagtctgctctttaaaaatgtcaaataaaaatcctaaaaatcacttccttgaaaaagaaatcactattactcaatgcacatgggacagaggggtggagataaaagattctccatgcaaacccctctctttctcccggttggacaaagattccttcatggacccgttctcttctctcgcctagcacatttagtgagatggagctaggaaggaactttgcgaattttgattggtaccaattgaaaaccaatttaatggtaaaaaatagtcactctctacataagtatgtataatcaaaggctaatataggttaatatgcacaactccttgccactgaagacatgaataattttgtaatggaaataaaattcttcaaggtgccctttagaataaaggaaccgtggagaataagaaagtgaggcttgcaatcataggatacacaaatatgggatttgtacattttttattattagattgcattaaagaaaatttatgtatgacttgaacttttgctacaaatttgggaggaaattaagtctgagttccagtctcgtgtcaaacttctttagaaagttcaaatgtgtcttctttgtttttgtctcttaaatataacacctaatctcaaagtccatgtatcttgtgcattttttgaaaagatgtatcttttgtgcgcgcatctaaatatgtcttctcaacaactcgtatttctcagatgaaaaaatagccaagtaaatcattgtgtgtttttttgttcttaccttgtcagattcatgtgtttaagggaaagaacccaaaacattaacaatagttaaaataacttatcgagtatgttaaatccaaacgcggttttgggtgggagagagagagagactacctaccatcaacatcaccgaattcctttagcaataaagaattattcctatatatagtactccctctgttttaaaatatagtgcgtccgcgctttctgatgttcaactttaatcataaatttaatcaatgagaccgactatggcgggagcaaaaaatatatactccctccgtccgaaaaagcttgtcccaagcttatctctcaaatggatgtatctagcactaatttgatgctagatacatccatttgagggacaagttttttcggacggagggagtaattgaaaatttcttttgaatacgaattcattggtataacttttgctcccaacacagttggtctcgttggttaaatttataatcaaagttgaagcacaggaaccgaggacgcactatattttggaacggagaaagtatgtggtaacttgcatgtggctatctacacaggacatgttgtttggtgggccagagacagtggggtccatgaccgagtgggcgatggcggagatgatgcgtagcccagacgacctacggcgactgcagcgggagctcgccaatgtggtggggctccaccgtaccgtggatgagaccgacctcgacaagctccctttcctcagatgcgtcgtcaaggaggcgctccgcatgcacccacccatcccactactcctccacgaggctgctaaagattgctttgtcggtggctactctgtgcccaaaggctcccgcgtgttggtgaatgcttgggcgatcaaccgtgaccccggggcctggaaggacggcgacacgttccgaccttcgcggttcatgcccggcgagggagaggccgccgagctggacctcaacggcggctgctacgagttcttgccgtttgggtccggccggcgctcgtgccctgcgcaggggcttggccaacatgcggtggagttcgctgtcgcgcagctcgcgcacggattcaactgggagctgcccgatggcatgaagcccgcggagcttgacatgggcgacatctttggcctcaccgcattacgtgccacgcggctctacgccgtgcccacaccacgcctcacttgccccatgtaagtatcgcaccagacttgctcatggagtgccttgtaaccgttggtccgttcattgtgtaccccgaccggcttggtttgttttggacttgatctccgagtcctaattcgcaagaagagacttcctatcaataaagatcatggtcatagatgtgcgttcatgagctatctcaatattcaaattgctcatgatattcgcgggggcgtgcgtgtgcgtgtgcgtgtgcgtgtgtgtgtgtgagagagagagagagagagagattttacatcatatcaaaaggatgtgcttttcagaaccatattggtatattatagttgttgatattctgatctatgatatggaattttataatgtttgaattataatagaaaaaaaacatgctttatgtttagaaaccggcgagtgccatttagggccagttattttggaataataccattttttgggtaaaaaacaaattaccgaattcctccccaatcctagcccaatagactccgcaccatgcccatcctaagattcgctacgctccgtgatcattactccttccaactccaaaatgaagtcttataagttttgtctaaagtcaaatggtgcaaagtttgatcgattttttaacataagttataggtgttctttttggagccgaaaggagttcaccacaacccattatgctcttgagcatactctcttccccctaggttcttaaatagtttacatgcatctacttgtataggcctaagtccgtaaaaaaagtacttgtatgcaactccaatgatgtacatcaaaatgaacacctcaaatgtccgcggtcagcggagttggtccttcaaccgtatgcatcaaatccggacagcggagtgagccagacgaacctaaaggacaaaatacatgagttgggaaggacatgtggtccaactgatagtggttcaaatggattatccgaactctcctaaagctccctcaggtttggttcaggtttgtaggaattcagatgtccaacctagtccgcagacgtttgctgaactgcattggagggcaaaaagtgtctgtaccgcgtggttcaaacgttcaagggtgatttggtgcacatcgtttccaaactaggttcagagccagctctttttagtttactttgcaacttatggtcaaaataagctaaagctagacataacttgaaatttctctccagcttaatttctaagcccgtccaaataatagttggtagaaaaaaactacaagagaagtgcttctagagcttctccgttagggctggaattcgagccgagtcgagccagctcggctcgacttgctaaagctcgtttcgttaacgagctagctcgactcgactcgttactataacgagctcaaatccaagattggctcgactcatataactcgcgagctggctcgtttagcttgttaagctcgttaaggatatgaacataaaaccttacgaatatgaaaaaaaatattacttgagaatgtataatgtacatattaaatatgtacaatgttcacaaaaaattgtaagcatgtatgagcatcacttacaattgttagtatcgtgcaggcgcagcgccgacgccgtcacaatttataggataaagaaacaaggaagacatgagggaaatcgaccgcctataacttcgctaggaatagaaatggaatgagagaaatcttcgtgtgcgatgtgtgagtcttgtgggcagttgggccttgtgttgtgcgcctgggacaccgagagcttggctgatcttttgtaccgagcctaaacgagttacacgagtactcgtgagatcgtctcgtttaacttggtctgtaaatgatcttaaactagagctcggctcgactcgttattcttcgagttcgagtcgattcgagccgagtcatgagctactcgtttagctcgcgagcttcgagcttttcttccagccctattctccgtaattcaaacccttccataaaaaaaagataatgtttccctctttttaggaaaaaaatgctaccgcataactcttcgtgctcgaatagaaaaccacatgcgcaattgcttcccctttgctccaacaccaactactactacgcctaactccacttaattaaccccaagggacaattgaagtactttctagtttgatgtggaagtattgagtgttcaagccctaaggagcaaatggataagcctcatattctatcaagttatatatggttgtgtgaatttctttggtactctactcgttttaataaatggttgtcta

SEQ ID NO: 95 - DNA, 5861 bp, Triticum aestivum
  source 1..5861: /organism="Triticum aestivum" /mol_type="unassigned DNA"
ttaaattatcctttactaacgaacatatacgtgatagcattgaatgatgtctttgaaatcagagtttgcggacgggtcatttgtccgcggacagatgccgatggaaattttacgggtcagccttggagatgcttttatactactactccgatacacggaaatctcaggatttgttacattatcagattattaatttttttgcgaatgtcattatctggaagttgaacaatctgttggaggttgacggaagaacgtgaagaatccacgcagctcgggcgccgtgtatatgcgacgaagacacacgaattccaatgactttgttaatttcaacatcactggttcgccttgtctgatacgttctcacaggtcggtttgctgtcacggaccgggggagtctgaacgagtcctgtgtacgtggtacaaccagtaactgtcttccgccaacattcaaggattggagcgaagctagaaactacaagaggttccgttgactaactcagtgatctcctgaaaagatcactaataaggttttactgtcaccttacaattctatcgaacccatgtatttgtaacagattttcttttttttgcaagggatattgtgacagtttctttactggtaatcgacgggggaagcccgttgttttccctcctcattttctcattgtgctttcgaaatcacgtgaatcaaataagatgcctatgggtatacttttcttttcttttcttcagattttcttatcgaggtgcagaattgtaaggtgacggtaaaaccttattgttattttctcaggagattactgagtgatattgatggaaaaaaacaacaacatgctcctgtagccggtccaccgaaagcacttttcacccttaattttgtttcccaccctcaagcaaacagtgagatttagaaaactcgacttttttatttatttgtggaaaaaagagagcatcccgtacggtttcaagtaactatataatgtctttcttacaaggaaaatgattgataccaaccagctgaaaaacaatttggcgccggtcgtctccttcagttgccacgcgtccgcttcgcttaccgcaaccttatctctttcttcttgcctcttcttccccgctggcatgcacaacctcctcttgctccaaccgcgatttgtggctcccatcaccggtcatcttccctgatgtatgctccctcacccggattcgtgagtcagattcacggcctctattgccggccatctccctcaccatgagcacccgccccgccaatgttgcaggtgtgtcacttgccgccagaccaaatccacaagctacatcctctctctctctctctctctctctctctctctccacatgatttttcctaccgacggatttcttcttcttctaaaaaagccaaatatgctttttccaacaagtgtcttgttgcaatgacaattatgtcatcgagcaggcgcgatgagattttctacaacaagatatctgttacaaaggtttctacaacatgaattctgttgtaaaggattctgcaacattaactgtgttgcaaccgtgaagggcgccgcttgaccgcatcagatctgacagctcgcgacctgaccgatcttttcggaatatcaatctgccgacgcatggcacgccccttcatacctctcctgcactagaaggggtaaaacagaatagtacacgcatatcatcccagtccggtgccaggccaacctctctcggagggaaggccttattcgtctcggaggggggctaacaaagaccggggcaacggttgttcccattaccatttgaattttcttgtgccatgcatcctcgagcctactcctttccctacttcattccagttagcaaatctcactatataaatccggctccttccactttcctcctcagctcactccacgagcgttatcaacatataggttcccccacaattgaataacccaacaaaacaaaaaagctagagcttccagcagtttgagtatccgtcaatggtgggcttggccaagatcgccatggactggctccaagagccactgagctggctcttcgtagcctcgttcgtcttcgtggtgctgcagcggcatcggcagcggctgcgtggcaaggcgccaccgctgcctccggggccgtctccgctgccgatcgtcggcaacatgtttatgatggatcagctgacccaccggggcctggcggctctggctaggcagtacggcggcattctccacctccgcctcggccaggtccacgccgtcgtcctgtcgacgccggagtacgcccaggaggtgctgcaggcgcaggacgtcgccttctcgaaccggccagctaccgtcgccgccatctacctcacctacgaccgcgccgacatggcgttcgcgcactacgggcccttctggcgccagatgcgcaagctgtgcgtgatgaagctcttcagccggcgccgtgcggggacctggctcgccgtgcgcgacgagtccgccgcgctcgtccgcgccgtggcccggcggagcggcgagtccgtgaacctcggagagctcatcttcaacctcaccaagaacgtcaccttccgcgccgcgttcggcgctgacgccgccggcgacgccgggaaacgggacgagttcatcgccatcatgcaggagttctcccagcttttcggcgggtccagcatcggcgactttatcccgtggctcggctgggtggaccagggcctcaacgtgcgcgcccgcaccgcgcgcgccgccctggacgagttcatcgacaagatcatcgacgagcacatgaggagaggcaagaaccccgacgacgtggacgccgacatggtggacgacatgctcgcgttcctccctgaggcgaagccgaagaaggacgctggcgacgacctgcagaactcgctccacctcacccgtgacaacatcaaggccatgatcatggtatggataccggaactcccatttctaattcacccgcaaaaagaaaaaaaggaacttccatttttaatttgtttgattcatggtatggtgcggtaaactgaagtgtgtatgtgacaggacgtgatgtttggtggcacggagacggtggcatcggggatcgagtgggcaatgacggagatgatgcacagccccgacgacctccgtcggctgcagcaggagctcgccgacgtggtgggtctcgaccggaacgtggacgagtcggacctcgacaagctccccttcctcaagtgcgtaatcaaagagacgctccggctacacccgcccatcccaattctgcaccatgagaacgccgaggactgtgtcgtcggcggctattcagtgccccggggatccagtgtcatgatcaacgtattcgccattggccgcgacgccaaggtgtggaaggacgccgacacattccgaccgtcgaggtttatgacgggggaaggggaggccgcaagggtcgacttcaagggcagctgttttgagttcctgcccttcgggtccggccgccgctcatgcccggggatggcgcttggcatctactcactggaatttgctgtcgcgcagctcgcccacgggttcagctgggcgctgcccgacggcatgaagccgtcggagctcgacatgaccgacatcttcggcctcactgcgccgcgcgccaccaggctctgcgccgtgcccacgccccggcttacttaccctttgatctctgatgttgatgccacgcacaaggcgtgacgtcaagtcgtatgcgcgcacaaaagtatattcattatgtagcacaataaagatgtttcactcgattcagggtaacactatatgagcttatattagacgacgggtccatggattcaaaatcgagtcaaactttgtaaacattgaccaagcgataaatcacgagtggacatgcggccacgcaaggaggaaatcagctccgtccactcccgcgtgattcgtgcacttattatacaaccagcttgtataataagcattgtatagtctttgtattaaatcagagagggcagctgtaagtcccacacgtcagttgcatggaacggcccgacatgcaattaatcagtcacccattacaacggctagctgcagcctgcagcatactcctctcgttgcctgcaccacgctcctccctctttaaatcactcaggccttcttcttcctctgcccaatttgcttctactatttgctctttctctctcacacacactttctagcatcgaatcgacccctttcacaaccatgtgttcatccatgtcccaagctatctctccaccaccttcatctcacgtcatttcccaatcaaattgcatctcttcctctcatatgctgcctcgagtgccaccctatctacgtgctctggttcattctagaagtgggagaaacaactacatacagttctacagcgccacatgaggtcaactcatatcgcactcaacagtctactgccatgtcccacttttcgaagataatcaagctttgctgaagaagataaccagccatgcatcagccattgccgtgctcttcctccacaaacacgaaaacttagtcccaggctgcaatcgtcgtctacttcatttacttttcagtttagaccttatctcaatccaaaccagccatgcatcagccatcaatttttttttctcaccaaggtcgtcaatgtaatagctagtaatttcagtttggaccaagctactcaatgtatgatccagtattggctgcttgttataactacccactcacattgtaaatgcctgccagcaatcaaggcacccaggaataattaatggcttcatttatccagtgtactacctgctcagcctgtattcatttattaggagcaggtcgtgattcgttatccttggccataatcacagtttggtattttaattttgtcacatgttttggactactgatttacaactgaaatctttacatgtatcattttctcacaaaaaaaatcagttagcttcattcttcattgttagctcgaatcatgaaaattacaacttgaatgtaaaacacaacatcaataaaaaatcagtacacagattctacataaaagttaaaatatttttacatggcttatagaatatttttgcggctttgattttgatctcagcttcacaatcatacttgtttaccaaaaattataattctcattgacaaattagagacatcaaaatcagctccacaaattcctaagtgaactacaagcagcatttaattaccaaaatgtatattgaaagtttgtcatggttgcagctaaatttgtgtgcttagtcaaaatggtagattaactgtggcacaacgaaccttagccgaagccaatcacacttgcttgctctccacagggacgcaacttgaacaagagctacaaggcatgccatgagcaaggccgatgcttctggacggctgccccacgtccacagcaattatgactgacccaacatgcaaggggcgtcgctattagatgagccgatattcatacgaaaactaaatgagatctggcccacatgtgcaaggtataacattgtgtatttatgctggcctgtgaattacctgctccgtattacgcagaggcctatattaagtagcaatcgcgatgcacatgcagacgcttgagatttcggcatcacgtgccaccatgtcccaaaaatccgcgtcgttgaccaagtccatagatacttttagattccccatgaaacatatcgtgcatttgtgggagcacttgctacagccaagcatgcatttttattccctccgttcctgaatagtctttttagagatttcaataagaggctatatccaaagcaaaatgagtgaatccatactctaaactatgtctacatacatccgtatatagct

SEQ ID NO: 96 - DNA, 6651 bp, Triticum aestivum
  source 1..6651: /organism="Triticum aestivum" /mol_type="unassigned DNA"
ctgcatttgaatagtgtcatttctattgtttgtcttcgaaactcccatgttttgaagacttccataaaaatattcacccccccccctctagtcgataactatccctttcaccttctctggtactctgccggagggggaatcaatcacggggggcttctacatcatccttgctgcccttccgatgatgtgtgaatagtttaccacagacctacgggtccatacctagtagctagatggcttcttctctatctttgatcttcaatacaatgctctcctcgatgttcttgaagttctattcgatgtaatcttctttcacggtgtgtttgttggatccgatgaattatgggtttattatcatattattcatgaatgtaatttgagtcttctctgaactcttttatgcatgattgttatagctttgtatttctctctgatctatccgtttggtttggccaactagattgatttatcttgcaatgggagaggtgctttgtgatgggttcgatcttgcggtgctcaatctcgatgacagaaagggacatgacacatatttgtattgttgccattaaggctaaaaagatggtgtttattcatattgattgtgtttacttttgtctacatcatgtcatcttgcataagacgttactctgtttgtattaacttaataccctatatgcatgctggatagcggtcgatgggcgaagtaatagtagtagatgcaagcaggagtcagtctacttgtctcgcacgtgatgtccgtatacatgatcattgccctgaatattgtcataactatgtgtctttctatcagttgcccaacagtaatcgttttacccaccgtatgcttttgttcaagagagaaacctctagtgaaaactatggccccgggtctacatttatcatatataaattccaaaaataccttgctgcaatttatttaccattatttttttgtgttttattttatctatctatcactacgagatttgatccttgcaaataatcgtcgaggggattgacaaccccttgattgcgttgggtgcaagtatttgcttctgtgtgtgtaggtactgtggccgatgttacggtactcgatcccgaggcacactccggcgttgaatcgcaaccgagagagcgggcatttcctactcttgaaggacttcttcgaacaccaaacccgctcttcaaacatcacctatttccattgtcgtttccgtatggctaggtatgttttcaaccgtatccgagagggagtggtgtcatacggtaagtatttcgagtgcaagaaatatgccctgggaaagattggcttctcctcttatcagaaatgcaatacagctattcggatgcttgcatatggagctcccggtctcattgatgagtatgtccatatgagcgagtccacgtgcctagctgacggtatctatcctcagtggactactcttgtgaagacaacctccaatcctgtagaagagaagaggaagagatttgcccaagagcagaaacttggagcactaagaagttgtggaaggtgatgactgcttgtgtgagcatgcataatatgatcgtagaggatgagcatccgaaacgtatctatgaccaagggtttcagtttcagggtgacaatgttgttcctgagcatggagggataacgttttgcacagttttccaatttcatcattaaatgcgtgattgaaaattttgcattcagctgcaaaatactatcctcattggatttgaaatatgtggatttcaggagcaaaatatgagggcccgtccggatgcgtccacgtccacggacatagagaagtcggatttgcacgtccggttatagatgctcttagatctcactcgtgagctttgctgatttttgggccggcaccctcgaacttttctcctcggctctactcgaaaagcgttactccagtctaaaacccacacagtagaataccccaagaagaaaacaataagaactagagcttctagttcgagtaccagcaatggtgggcttgaccaagatcgccatggaatggctccaagatccgctgagctggctgttcgttgcctcggtggtcttcgtgatgctgcagcggcggcggcggcggggcagggcgccgccgctgcctccggggccgaacccgcttcctatcgtcggcaacatgtcaatgatggaccagctgacgcaccgtggcctcacggcgctggcgaagaagtacggtggctttctccacctccgcctgggcaaggtccacgcctttgccgtgtcgacgccggagtacgctcaagaggtgctgcaggtgcaggacgccgccttctccaaccggccggctagcctcgccgccacctacctcacctacgaccgcgccgacatggcgttcgcgcaccacgggcccttctggcgccagatgcgcaagctgtgcgtgatgaagctcttcagccggcgccgtccggagacgtggctcgccgtgcgcaacgagtccgcggcgctcgtccgcgccgtggcccggcggagcggcgagaccgtgaaccttggcgagctcatcttcaacctcgccaagaacgtcaccttccgcgccgcgttcggcgccggtgccgccggcgacgccgggaagcaggaggagttcatcgccatcctccaggagttctccaagctcttcgtcgagttctgcatcggcgacttcatcccgtggctcagctgggcggacccgcagggcatcaacgtgcgcctccgcgccgcacgcgccgcgctcgaccagttcatcgacaagatcatcgacgagcacatgaagaggggcaggaaccccgacgacgtcgacgccgacatggtggatgacatgctcgcgttccttccggaggcgagaaccaagaaggccgccggcgaccgcggggacgacctccagaacacgctccgcctaacccgtgacaacatcaaggccatgatcatggtacgtggtagatccaaacttccgtcaattatttactgccatatgcgccaaaaatagattttttctaagaattaggtaagcttcagtcaactctctagctcccagatctagacatcaagagccgtgtagaatttctgtattagataaaaaaatgtttgtttattgacactaagaaccggaccgactccgtcaacttttaaatgcttattatacgaaaagtagccgctacactcggggtgtactacacccgactttgcaaaaacaactgaaaaaacgttatcaaaccaaatctgaaaatctgagacatcaaaccttatcaaatgttcgagcttcttgtaaactttcagcaacattgattttgtctttttattcggtgagaactcctcggatgttatttttggctgaaattttacaagatcctcaaacatttttataaagtttatatgttaaattttcagatttttcaaatttggtttgatcatgttttttcagtttttcacaaacttggttgtactaaacccacgagtagaacatctactctgacgcttataaggtactccctctggtccataatgtaagacgttttttaacactagtgtaatgttaaaaaacgtcttacattatgggatggagggagtagatctatcgttcaaatgtagtggcggtgcacaagccactaacttcagatcaactcgattcttagctctaacttcagatcaacccaaaagaaaatgagttactattagcctccttttgcagctcggctacaaaatgagctgagtttggtcgcaagtcttacctcgctcgattttacctcgacatagctcagaatactcccttcgattcatattacctgtcactcaaactgatgtatttagtcatccagatacatccacttaaacggcaaataagtaatatgcgtcgaagagagtatcataatgtgttttttctttaataatacagggaagctaaaatgtgtttgttaccagtactatgttttttaaactaaaatgtgcatgcatatatgtatgtatgtacgacaggacgtgatgtttggcgggacagagacggtggcgtcggcgatcgagtgggcaatgtcggagatgatgcactgccccgacgacctccgacgtctgcagcaggagcttgccgacacagtgggtctcgaccagaacgtggacgagtcggacctagacaaacttcccttcctcaagtgcgtcatcaaggagacgctccggttgcacccacccatcccattgctcaaccatgagaatgccgaggactgtgtcgtcggcggctactccgtgccccggggctcccgcgtcatgatcaacgtctttgccatcggtcgtgacgccagcacgtggaaggacgccgacgcgtttcgaccttcaaggttcatggagggggaaggggaggccgctggggtcgacttcaagggtgggtgctttgagttcctgccgtttgggtccggccgccgctcgtgccctggcatggcgctcggcctgtactcgttggagctcattgtcgcgcagctcgctcatgggttcaacttggcactccctgacggcatggcgccgtcggagctcgacatgcgtgatgtcttcggcctcactgttccacgtgccaccaggctctgcgtcgtgcccacacctcgactcacctgctctttggtcgctgatgatgatgccgcgcaccaggcatgatgtcatgcgtgcacctattgtctttgtgtgccccaccgcctgagtttggtgggtttctctttgcctttttcttcttctattttctgatactacagaacacaataattggatcttctatccttagcttacagattgtgatgcgtggctatttttcatgtatatttttttgggagggggtaatgacacatgaagcaggctctaccatgaagatccatatttcggtggtagtttgagcattgcacgtttcatgtcatcatcctcgcttgttgcgacgagttgttgagcaattatacaacaacgattgggataacccactacagcaatagagacatgttttttttttgcttgatttttgactttctagttggctttctcccaagaacatggagtacaataggaagttagtaaaaatgtaggatttaaagatgtactaaatttcaaaaatgtgcacgaaagtgaaaaatgttcagaaattttaaaaatagtcatgttctaaaaacacgaattggaaaaatatacactaatatcaaaaaatgttcacgcatacaaaaatgtttgtgacctttaaatttttttgtcaattaaaaaaatcaaatgttttgaaaataaggtaaaagaaaaccgaaagaaagaaccgaccctgctagccactccgcccgcttctcgttcatggtagtagtagcggggcgttctcttgaggcaattcgagccggttctctcagtttttttttctttttcactctttttgcatttgtttctttggttttttttatttatttttctttgatttattttgtttcagtttttgtttttaattttttagttttctctgtttcctttggttttaattctacattttttgtgtatgttaacaacatttttcttcacatttaacattttttcaatacaaaaactattttttaatatatggttaagatttccctatcacatttttaaatgcttgattaaaaaaattgcatacaagattaaaaaatttaatacatggtcaacatttttctatacacaactaacattttccatacccttgattaacattattcaaatacttgttcaatatgttttttcaaatgcttggttaaaaaattatatacatgataaaaaaattcattattttttaatacatagtcaatattttttatacatatttaaaaaaattcaaatacttgctcaatgtttttcaattgattaacatttttatatacatgatcaaaaggattcatcatttcttaatacatgatcaacaatttttttatacacgttcaatattgtacaaattcttcattcacatttttcaaatacttgttcaacatttttcaaatgttttttaaaagtataaaaaagtacaaaaataaagcaaaaatgaagaaaaaaataggctgtggctagtcaacaaggcccaaagtggtcaacaaaagtcaagaaagctcagggaaatcaacacaagtccaagacagacaacaaaaatccaagcaagttgtcgttgtcaataagtcacaagagaaggcaaaataaaaggcccaactagccaaaggcccattcatgcatggatgaagctgagtggtgcaccgtaaactatggagaccttcaactttggccaattttcatggactcatgggcctagttttatcgcactacacctcctacatacccaccaccatgggcagcattaaatcatttgtcaaggcacaccccctgtataaggcctccataggcatgtaacaggttcactcacgtcaatagactaaggggagggcactagagatcttcgagttttgctcctaaaatgctctaggatcgagtccgaggagccgcatcgcgactcagatcgacgctagagatctagaagcctgctctcaagacgttgtaggggcaagtccttggagccgtatcgcctctcggatcgacctcggtcgagagttagggagagggtttcaaggagtcgcgtcatgacttcgagcctacgacagtccatcctaccc

SEQ ID NO: 97 - DNA, 6761 bp, Triticum aestivum
  source 1..6761: /organism="Triticum aestivum" /mol_type="unassigned DNA"
agtcataataggttaagtcttaatccgacttggactctacatgtaagccactccttgaacttatatatggaggggcaggtgaccctaagagggtcaagtttttagagggtcacagtagacaggttaagatagtcagggctttgacagacaagtctaaaacaagatcaaagtagatgctctcgagatagaggtagtgaaacacgatcatcatcatcaatatcaatgaagtaggatgtaggcttttacctccaccgcgagggcccgagcctgcgtaaaatcttgcgtctctcgtcccactcaaccccgctcaagctaccatttagatgagttggcctcacgactaagtcctcacactaagatatctgccgtgacaaaatcacgacaacgagtgttgtcatccgtggtggttgttgttgggtggtcgagttcgcttcgacaggaatctagtggttgcattttatttttcgtgttcgtattggtgttggttgtgtgcctcccaatcgtgcaaaaatcgagcatgcgaccccttcggtaaataaaattcgccgttcaccaaatgactgcaatttaaacaccaagagacaggacgcatcttgctgtaaacgagaacttgggagctgtggctcgctgactcccattcattagaaaactgacatatcttatctactactactatatatagtctagcactgagatcgatctggaatcgtttcggccccaacgcgcatctctgctctctgccgcaacatatatatctctcggccccaatcattctcggtccatctgccgtttggctacgtggcacttctggccggccctgttggcatgaatacgtggcccattacagtattgattagagtacggtcagaactaaagaatccacaagatagcacgccgtgcaggttcctgcatgctgggaatctttaggacaaaaaaaaaagtttctcatgtttttgttcacagcggcgattaataaggacaagcttgagccagcgaaaattgacatatgagatcgggcactttgtgcccgttattttggagttcgaaaattgcatttatacggcttgaaaaaattccaaaattttatgtacatgctatagcagtgtagtataacatgccaaaatttcgctaataaacatatgcttgcattgcatgtgagagctaaaaaagacaaaatacatgcaaatttggggccagtttttttcgattttgagctaatttttcgccttttttgtgcagtgtatacaataatgggcacatgcatgcgtattcatgtgttttttttccaaaaattttaagcacttgttttggtgggttcaaaataaagtactccgttgccccatgttctgaaaatccattttattaagtcaggccctgatcgatgataagcctagtcagatgcttattactgtaagaaccgatgcagagatgcctgcagtaaattgttaggaaacaacatccgtatcttgtgaaattatttacaacaagtacgatctgacatggatactctaatttagatcacagtatccgtgcatatgggtactagtgctgcaaaaatctctgctggtttttggcattgttatcttgatccagataacaaatcgacatggcttgtgcaatgggattccattgttgcatcagctctcataattaggctaattttgacaaattaccagtagcatgctgaattccaagcataccactaaattgtctaaacctacaaagtttctccaccggtgcctcctttttctaaactttgagcgactgctggcctgacttcacacgacgcatctttaatatggttcaaaaagactgatgtattgtttcagctggtctgcctcatctcaatttcgggagaatattatacggaaaccaatattaataaaaaattgtgaaaatcatattttaaagttttgaaaaaatctgaaaaaaaattcggaatgttaagagtgtgatgttttattgccacgcaatttcatgttgaatttttgcgtggtaataaaacatcaccctcttaacatcccatatttttttcagattttttgaaacttttaaaatatggtttccacaaagttttcattaaattggtttccgtatgatattcttccctcaacttctgctccaactatatattacccggcatcctccactcttttccttaccctcttacaacacatcaacctgaaacctgcactgcacagtcgagaattctccaagaaaaaaaagttagagcttctagtttgagtatcaataaatggtggacctgtccatgatcgacatggaatggctccaagagccattgagctggctgtttgttgcctcggtcatcttcgtgttgctgcagcggcggcgtggcaaggcgccgccgctgcccccaggaccgtattcaccgccgattgtcggcaatatcttcatgatggaccagctgactcaccggggcttcgcagcgctggccaagcagtatggcggccttctccacctccgccttggcaaggtccacaccttcgccgtgtcgacgccggagtacgcccagcaggtgctgcaggcccaggacgccgccttctcgcaccggccagcaaccatcgccaccacctacctcacctacgaccgtgcggacatggtgttcgcccgctacgggccattctggcgccagatgcgcaagctgtgcgtgatgaagctcttcagccggcgccgtcctgggacctggctggccgtgcgcgacgagtctgcggccctcgtccgtgccgtggcccggcggagcggtgagcccgtcaacctcggcgacctcatcttcaacctcagcatgaacgtcaccttccgcgccgcgtttggcgctgaagccgccggtgacggtgatggccggaagcagcacgagttcatcgctatcatgcaggagttctccaagctcttcggcgcgttcagcatcggcgacttcatcccgtggctcggctgggcggacccacagggcatcaaggtgcgcctccgcgccgcgcgcaccgccctcgacgagttcatcgacaagatcatcgacgagcacataaagaggggcaggaaccctgacgacatggacgccgacatggtagacggcatgctcgcgttcctccctgaagccaagccggacaaggccgcgggcgacgacctgcaccacacgctccgcctcaaccgtgacaacattaaggccatcatcatggtacgtaagcatcaccaaacatccattatgtgttgttagcctctatatatccgtctaccatgtttattatctatgatgttttctttattttcgttctctattgttttctgaattcctttccaacaattgaatcttgaatcaaaaagtggtttggtatgtcatgtgaatatggatattaaattaaagcatatgtttgaaaatattcttgctgacttagtagaatatttatgtctctattgcatatacaccgacaattaattagtaatcaaaatgaatttgtgccatccaacattttttcggaaacaattatggaaccttaacactgttcagccaacaacaccacccattgaactttcgtcatccatgagacttctatgtttttctaagtgacatactccctccgtccggaaatacgtgtcctaagaatggttgtatttggacttgttttagttatagatatatccattttatttatttttaggacaagtatttccggacggagggagtatgatatactgtaagtactatcagactgctctgtttgtgtgtgtgtgtgtgataataaagtaatgtgttgacgcggcctgcctgcaggatgtgatgtttggcgggacggagacggtggcatcggcaatcgaatgggcaatggccgaaatgatgcacagcccaaatgatctcttgcaactgcagcaggagctcgccgacacggtgggtatcgaccgaaatgtggacgagccggacctcaacaagctctcctttctcaaatgtgtgatcaaggagacactccggttacaccctcccatcccgctgctccaccgcgagaatgccgaggactgcgtgcttggcggctactccgtgccccagggctcgagcgtcaatatcaatgtcttcgcaatgggccgcgacaccaaggtgtggaaggacgccgacacattccgtccgtcacggttcatggagggggaaggggaggcagcgggggtcgacttcaagggcgggtgcttccagttcctgccgtttgggtctggtcgtcgttcgtgccccgggatggctctcggcctgtactcgctggagctcgttattgcgcagctcgcccatgggttcaactgggcgctgcccaatggtgagaagccgtcggtgctcgacatgagtgacattttcggcctcaccgcaccacgtgccacaaggctctgggtcgtgcccacgccccgacttacctgccctttggttgttgatgtctgacgccgcgtgccagacatgatatcgtgagcgcacagctgatggtatctaccagctgcgcagggcgtgatggtgtttgatcagcgtgttagttaatctagttgtagctgtagctattttccccttttgtgttagatatttcctagcttcgtttagacacgatcgcacccgtataaatcggctgccctggacgtggaattgtgggcatcgtggagccgggtcacgatcgttcctttcatcatgaataaaaaggaaatgaagaatgacagaaaaacaggaagttgttcgtagcacaaatgtttacaccagcatgttattcttgtcctttgtttctcctccttccgcgaacttggttgataacgatgttgttttcattttcgagagttagttacacttttgatatataaacctgcaattgatgtacatattcatacgtaaacttgaaaaaatgatacaaatcggtgctacaacttgtgtttcagatacattcaagtacatttcgctgatgactctccgttaaattctgcacgttagtttacctacacttcatatctgcgcatgggtcacgcaaagaaagaaagagaaatatatatatagcaaaaccgaaagaaaataagagcgtacgccgcgcattgccgctcatggtaaggcgccccagcccatccacctttgacctaggcagccgccatctccaaaatctaaggttttctgcctcccgccggcgccggcgccggtccgtcccgtctccggtggccttagggccatggagacgtggtggatctcagcccttgccggtgggagggctccgtttttagatcttttttcaagctttgttaggatttgtatcctgctcaggaaggcaagacggcggcggctccctgaagatggaataaatgtctccccgcctagccccccttccggtgatgcgcttagcatcatcggtgggcatgtggaggtgtgtctccggcggatctgtctttggtggatttgctcggatctgttcgtcgttcgtgttctttgtttgtcctcagatttgatccttttgatcgacactcttcatctgcggcggttgctgttctggtgcgttggttctatggacccttagcacgacgacttcccgactgtctactacaacaacgtttgcccggctccggcgagggaggggcgatgacagcggcgcgccttcggcgcttcagtgcttgtagtcgtcgctaggtggtctacgaatctggatgtaattttttattatttttagtgtttattgcactaacatgattgaagatgaatagattgaaagtttttcccgcaaaataaataaataaatatatatagcaaaacccattgcgcacggttggaatcaaactcggaaggttgcccccaacactacacgtgccaaccaattcaccacgtgcagctttctattagcgcgcgttatatatagacattcctttagatgactaggaaacaattatgaagtcaaaacatacactgctagatgagagaagtccttatttaacaccgtgtctaaattttatgccctatttgacatcgacaaataatgtcttccctatctaacaacgagtctaaattttatcccttttataacacttctgtccattttgagccaaatgacacctgaaaagaccattttgccctcacgtggtttgtttgtgtgcgggtgtgcgcgcgcgtacgtgtgttcctgcttagtgtgtgtgtgtgtgtgtgtgcatgtgtgtttgctattgtgtgtgtacgtgtgtgtttgtcactgggtgtgtgcgtgcatgtgtgtgtgtgcgggcgcgctctgttgcgtgcatgtgtgttgtgtgcgtctgtgctgctgtgtgtgctacgtgtgtttgctgcagcagcgtgtgtgtgctgcatgcgtgtgtctgtgtgccgcgtgcgtgtgtgccgctgcatgttgagtgctgcgtgtgtgttgcctcgtgtgtatgtgctgctacgtgtgtgctactgccctcgcacagatgttacgtgtgtgctactgccctggtctgaacaacgtgttttttcttctcttgtttggttttattctgcgcaggaccagacaacctggtttccaaaaaaaatctgaatttctagtagctttttcttcgaaatttccaaacggattttgaattcaaatttcaaacaaaattgagttgaaaaaatatgagtttttgaccgatataaaattgggggcttaccaaaaatattaaatgaaatttaaatacatgcatacaagtttattttacaatatctgaccttttaaattgaaaaaacttaaaattttgaacgatatcaaaaacattgggggctcact

SEQ ID NO: 98 - DNA, 5635 bp, Oryza sativa
  source 1..5635: /organism="Oryza sativa" /mol_type="unassigned DNA"
accacatggtattacatggcacgtcaattataatttaggcatttcgagatgaacatgacgtacacacttgtaagatgaagatgttctctccacacaaccataaccagcccattacccctcactatatatactaccaacttcttcatcggtcgtgcattgttgtattctttcgccaactcgtttcttgttttcaaagttgtgtttgagtctgttcaagacgaagatgaagtgcaggtatgtaaaaccagaaagtcgttagcgtatgattaattgggttataattattacaaacttggaaaacatatttatttgatatttctaaaaacaacttccatataaaaatttccgcataaaatgtaccgtttatcagtttaaaaaacgtgctaacaaaaaccaagataaattttgtatcttaatcaagttagaacgtatacccaccaatgtttgatccgtcaatttcatattgtattgctgattaagtttggtataatttgccattctatttgctcttaaggctatggtaaccactgtacatctctttgcatgtttaatcactaaattcatgattttatttgctgatcttgcgcatattactgtgttgtagttgatattttatttgtattcatttgctctgttttggatccaagagaatttaatgtgtatgtactttctgtttagtttcaggtaggataattgaagttggatgatcctacacctccctttaagtatttcattcactcccacaacaactgaattatttgtttggtggctgggtgtccttcttcaaccgtgcatattttcattgtgctaaaaatgttatatttcctcttgagttaaagtggtctcaaatatgaaatacctaataatgttttccctttctaatcctaaataaattaaattcctgaatatttctttgaaaatgtttttttagtacatatgaagtatactgtataccacatatgcttcagtatgtatatgtgtaaagcggcatattaattggatatgaagtgtatggcgtaaaatcgggttagattataattgtaaatttcagttcaatttgcaggtttaagctggttatccttagattgagagtttttaatcagttccatgaatatagaaattattgctgttttttcccggttgtaataaatccacagacaaggttatctgaaccttgcatgaacatactctttaatactatctccattttaaatacatagtattgtttacttttaaacatatatgtccattcgtcttatttaaaacaaatatgctaatatgcaaaaatataaactgtatttaaagtaactttaataataaaataaatgatgttagcatattttctaaataacatgaatgatcaaatatatgtctaaaaatcaacggcattatatactaaagaaaatggagggagtaggaatcagcgtatctgctaaaattaagtcggatacaaccttataatctcaatataacctcgtaaccatttttcctctttgagtgccaggctatctaacaacactagctccaaaagttcttgatgtggcatggtggacatgaatttgtaactgcatgcaggattccagctcagagaattgcaggctgttgatatctcatccctgatttctggtgcccgttattgtatcatctagcacatttagagctgatgcttttgataattaaattaaggagaaaaaaaagagaggaactgatgttttttatcctaatctgaggagaaaaataaataacagttgcttttaagtcactaatctaaggagaaaataaagaactgatctaaccactaatccaaggatgaaaaaaataacagagatgaactgatccttttgccaagaaacccggaagaaatgatccaggaatgaaataatcttccccaaactttcgttgagcaatttatactacgaaatttctacctatataaataggcgcattgcccctctcccatttctcaccagcttcgatcacattccgatcaagctgcaacaatggcgaacggcgtggcagagtacttgctgatggacccgtggcttgttctatggctcgtcctggcctccatggcgttcgcattgctgcacctgcggcggcgcgcacgccgtggggcgccgccgctgccgccgggtccgcggccgctgccgatcatcggaaacatgctcatgatggaccagctgacgcaccgcgggctggcggccatggcggccaggtacggcgggttgctgcacctccgcctcggccgcgtccacatggtggtggtgtcgagcccggagcacgcgcgcgaggtgctccaggtccaggacggcgacttctccaaccggccggcgagcatcgccatcgcctacctcacctacggccgcgccgacatggccttctcccactacggccacttctggcgacaggtgcgcaagctcagcgccgtgcggctcttcagccggcggcgcgcccagtcgtggcgcgccgtccgcgacgagtcggccaagctggtcggcgccattgccaggagagccggcgaggccgtcgacctcggtgagctcatcttcgggctcaccaaggacgtcatctttcgcgccgccttcggcacgcgcgacggcggcggccacggcgagctggaggttctcctgcaggagttctccaagctgttcggcgcgttcaacgtcggggacttcatcccctggctcgcgtggctcgacccgcacggcatcaaccgacggctccgcgcggcgcgcgccgccctcgacagcgtcatcgacaggatcatcgacgagcacgtcagcaaccccgccggcgacgaggacgccgacatggtggacgacatgctcgcgttcctcgacgaggccggacgagaccaaaccggcggcggcggcgagctgcagggcacgctccggctgacgcgcgacaacatcaaggccatcataatggtacgtgccattctgacaccactgccatggcatgcacgtcgcgttgcttgatggagttggcgacgacaagtgcaggacttcgtcttcggcgggacggagacggtggcgtcggcgatcgagtgggcgatggcggagttgctgcacagccccggcgatctccggcggctgcaggcggagctcgccgacgtggtggggctcgggcgcggcgtggaggagggcgacctggagaagctccccttcctcaggtgcgtcgccatggagacgctgcgtctccacccgccgatcccgctgctcctccacgaggcggcggcggactgcgtcgtcggcgggtactccgtgccgaggggcgcccgcgtggtggtcaacgtgtggagcgtcggccgcgacgccggcgcgtggaagggcgacgccggcgcgttccggccggcgaggttcatggcgggcggcgaggcggcggggatggacctcaggggcggatgcttcgagctcctgccgttcgggtcggggcggagggcgtgccccgccatcgtgctcgggatgtacgagctggagctcgtcgtcgcgcgcctcgtccacgcgttcgggtgggcgccgccgggcggcgtggcgccggaggagctcgacatggcggacggcttcggcctcaccgcgccgcgcgccgcgaggctccgcgccgtgccgacgccccggctcacctgcccgatgtgacgcgcgttctcgatttggcgcgagagatgcgcaacgcagctcgaagtgtgactgtgacagtgtgagcgtgtaatctggtgtggacatcgtatgcatcatgtgtgcttatggataattaaatatataaataatatttggatgtggatttcggctgaaattttctgtcatttcgaaaaaaattcgtcctagaattcaaatagaatattttttttctcattattttttatagttgcacattggctacattatctgtagaagcttcttgattcacgagatctagcgggcgtgacaatatggtcaaagaattctttaccctagacatgggcgtcgatatggtcgtaaagctgctcttcagcttagtagccacatccataatttaatcttaggattatttttacagttgattccgatattttttcatcgtaaacatggggttttacatcattaaaaacccacatataaaatcctttcccttaaaagaatgatggtctttgaagcccttatttctttttttaatcttcgagtatgtatgaatagtttgattacgtgcattttaattatgtagagatttggaatgctattcgacaattatattatcttaatgttacattaagtgagatgcttttattatttaaaaatcgattatattttaaaacaaaatctgaagcactccgtggaccgtggttacacgtgccaggtcgacgtgttcttctggaagaaatctatgtctacttttgaaatggaatatactacctccgttaaaaataagtacaaacgtaaataaataagtacaaacgtaaatatccgtatgaacgttcgtcttattccaaaaatttataaaaataaattataaaaaaacagtcacatataaaatattatttatgttttataatctaatagtaacaaaaaaatattaatcataaaagataaagaaaaatttaaataagataaacgctgaatataaataatattttataaagctgtacttattttaagacggaaagagtaaaaaattttggaaaaatttctagtgcagcatgctgctcatttgggaggtgtgtgctgctgctctccagtctcccccaaccaaaatttgaccgagtttggcacgaaagaaaccgcctcgacgccgtccaacggaagccagccgaggcgaccaacccaagggtaggcctaggcgtaaaccctgcacctgaatcgatcgccggcgatggccacgacgctgacgccgacgcagcgctacgcggcgggggcgctgctggcgctcgcgctccgccaggcccagatccaccagtccgtcctcctcggcgcccaccaccaccacgacgacgacgacgaggaacaggggcgcaccagcaccagcagcggcggcggcggcggcagctcctcctcctcctccaactccggcgccggcgccgacgccgacctctggacacacgactcccacggcctcctccgccccgtcttcaggtgttttctcgctcctctccgcttgtaaatttggggggtttgagatgaatgcttccgctttacttggcgatcggggggctctgctaggttcctggagatcgatcccaaggcgtggtcggggctggaggagacggcggcgtcgtccgaggccaagcatcacatcggcgcggtacggcactcactgcattttctgccctcgtattgtaattggccgtgcgttttggtcagtgttgcagtgatggtttggggcttaggtgtttgattatatgcctacaagactgttcaacttcaatttccgcgtgtgcttgaccagtgaaatttgtgttttcgtagcatctcatatcactctcattttgtagtttctaaggataatattcgaagaagatggcgaaagctcctcagacagatccgttcaggagcttgccttggcaaaaggagttgatgtgatggtaatgagtttgggcaatgacagtgaagtgggtaacacaattaaaggtggggatcaagatgctttgcctagcagctctgga

SEQ ID NO: 99 - DNA, 10744 bp, Oryza sativa
  source 1..10744: /organism="Oryza sativa" /mol_type="unassigned DNA"
gttgtcgcagaacttgttacaattgtatagtcctttagttttttgtactaatgtcatattggcaacacatattccttgttgagttggtactacctgcatcagcaccttaatctttcctagtttgctctgctaatgatgaacaatgttatcaccaagttagagcagttacgtaactatagagtatttgttgtacaaatttcttagcctacttgccactaataatataatggcaatatattcactcttctttacgagaatacatccatcaaaatcagatatgatctttgtattatcaataaattgtttatctatggggtccatgaatatgtgattgtggcttaggtcgtgttcgattcagccgtctggcagtattattgtttgtaattagtattatctattataaacttaaaaataaatatacttaattttaagaaatttttatataaaattttttacacgaaatgtaccatttaacaattttaaaaagtgtacttactttatgagaaatgagtaataaagctcatccgagaatccaaaaagaacgaaccttaattaggccttgtttgtttcctattgagtttttgtcttcaacttaaagccaacgaaagcttaaggttctcgaaacgaaattgtagcttctctacttctggaagaggctaaaagccaaaatggaggttacaaatgtatctatcagctgtgatcgggcccacatccatacatttctttaaagaaaaagaagaaagagaaaaaactctgtagctagtttttttttttattttttgaacttttaaattttaaaaataaacccttataaaacttgttttcaagatctgaacattttcgtcacgttagccaaactgacttggcaaaacaacattgtcacgatggtttggctgacgtggcagcattatttagtcacgccggtctggctggtatgacaatgttatttgaccactccgccctcgatgacgtagcagaataaaattgtcatgcccattatgtgcgacgtgccagtgttgttttgccacgcaagacagacgggtgttgctaaaagtttcagattctggaaaaaaagttttggcaaggttaatttttaaaattaaaaaataaaagttcaaaaaaaaattgtagctagtatggaaggtgctgagaaagcaactgaatgcaattttccaaaatggaatagttatggatttggcggatacaatgaaaataagttgaaagtgaacatttgtatttgttttcttgatccatcctttaaccgtatatggtgatgtaaacagctagtcttaagaaaactgaaaaatatatggtgatgactgatgaataccaaatgctaatcgtgtacggtcgtttaagcatgtgcactaaatatacaaaaaggaaatgtatctgttcaacatcttggattagactaagcattcatggatcttcagcccaactgtagtattgattactatttgatatgaacaattccagacctcgtgttggacaagttcaccctgttactttggccggctaattgccagtttgccaattgccaccacttgctcagtcagttgtgttactcagctgtgctaacgtaatttccatgctattggcaaacctaatttgctgcaagatatggaagtgtcaataaaaatatattacttttaatagtaacgaaaatataataagagttatgatataggatacttcatatatctaaaaatatactaaattctaacgatgtatttggatatatttatctaaatactagtcagaagttactatattttgagatgtggatatataggtgtcatgaaaaatgattgaaggagaaccttttcgtgatatactgggacccactgcctaaaaatatagaggaaaaaaaaacgaaaatgcatgtatctatggaaatttgagatcctatactagtcttaaaccagatataaaaatatcattcctcacctactcctcccaactctatataaaccctggatcatcctaactttctcctcagctctacaccaagagcgcttataaacataaaaaacatctcaaacacaacccaaaatagggccaaaattctagaatattatttttgttttgaaaggaatttaagtttgtgtggtgtgtcatccatggcggacatggtgaagttcaccatggagtggcttcaggatcctctgagcctggcgatcgtcgtcacggtggccgtcctaatcatgcggatgcagcggcggcgcgcggcgccgttcccgccggggccgaagccgctgccgatcgtcggcaacatggcgatgatggaccagctgacgcaccgcggcctggcagcgctggcgaaggagtacggcggcctgatgcacctccggctcggccggctccacgcgttcgccgtgtcgacgccggagtacgcgcgcgaggtgctccaggcgcaggacggcgcgttctcgaacaggccggcgaccacggcgatcgcctacctcacctacgaccgcgcggacatggcgttcgcgcactacgggcccttctggcgccagatgaggaagctgtgcgtggtgaagctcttcagccggcgccgcgccgagacgtggctcgccgtgcgcgacgagtccgcggcgctcgtgcgcgccgtggcggcgtcgcgcggcgaggccgccgtcaacctcggcgagctcatcttcaacctcaccaagaacgtcatcttccgcgccgcgttcggcacgcgcgacggcgaggggcacgacgagttcatcgccatcctccaggagttctccaagctgttcggcgcgttcaacatcggcgacttcatcccctggctcagctgggcggacaccaacggcatcaacgcccgcctcgtcgcggcgcgcaccgcgctcgacaggttcatcgacaagatcatcgacgagcacatggagcgcggcaagaaccccgacgacgccgacgccgacatggtcgacgacatgctcgcgttcctcgccgaggccaagccgcacgccggcaaggccgccgccgccgccgccggcgccggcgacggggccgacgacctgcagaacacgctccgcctcacccgcgacaacatcaaggccatcatcatggtacgtgcagttgacaacctactagtaattaattactgccaaatttttcaccaacttaatctctctatcacggtaatgattaattaccacttactcctcccggccgatcaagataaaacccgatcgaaattaggcaacaccaaatccgtaaaattactggaattaatgattcaccgatttagagcaagtttgatagtatagccaactattaactctaaatcatctatagcaaatataatagctaatttatacaatagttacttactatactattaatatctggtcccacctgtcatacacacattacgtcttagagttcgtgctgcagctggctatagattttgtagcccgctgctcttttctctcttgctttatctttttaaaatatatttatagttggcttacttatagcctgctattgtaactactcttacacagcacagcagtatggagtagtaatatatatcttaaactctgacaattaaacatgataaattcatctgacgcaaacacaactgtacgctataaatacgcgtacaaatcagcaacagtagtgtacggggccggattattagtcaggtaatatatcattttattttaggcgattaagtcaggcaaattatcttgatccgtgtagattatttgacagggcagagatctctcctggtatagttgacatgaacaccatgtgcagtccatgtgtgtgttcgcctcgtttgcaggtgaatcgatatgatcaaccgttagatggcgccacgtatgcatcatggatcatagattaagccctgcaaattaaagccactcaatgaaatgctagatttgaggagtaattaattttagtgtagaatacagtggtcctccttgatgcatccctcgcaatgtatctgcacttctacaggcagtcaactcacttacataagcattgtcgactgttcccgaggagatcgacaccgtcagatacggcattaacctatgattatttatacccatatttcaatatacgggtagtaaaatattccgagaattttatggagtagcacgtactcggaggaagtagtaaaaatagctttgtacttatccctccgttgtataaaatatccaatccttaccatgtacttcctccgtaaagtcgttttgaacaacgatacggtctccaaaatacaactttgatttcttgtttctataaaaatatctattaaaaagtaatatatgtatacttttatgaaaatatttttcaagacaaatctattcatataatttttacattttcaaactcaacaacttaagagttattcatgatttatattcctaagatttgacttaaaaacagtcctaaacgacttcctttacaagcacagagggagtacccggatatatacgtgtctagttacgtggctagaaattgtctctctctttttcttttttttcttttttgatatagtagtatatcggatacagctagaagtaactatagtgttagccttttttagcgaataaaggtagaagctaatctttaaccacgttctggtaggatgacagctctaattttatttcacatcttttagatgtggatgttttcagcgtgtaatatatatctcctttttcaaaaaaaaaacctatattttaaacgaacttatataggaattttcagtggtagactgaataagtgttttgacttgctggtagaacgactggatatttgcacacacgaataatcttacagtcgcttggcgcaacagccaacctagcttgaggctcaaattaaagtcagagcacgagcctgaccaacgccggccggcggcgggtcttctccggcgccggcggccggtgatcgatttcatttccaggcttattctccgcgtatgcatgatgtgtcaagctactgagctatagctagccgtctctctcgtgtacgagtctcttaccactcttggctagcaaatctgacgactctttgactgaacgaacaactcgtacgtcttaaaagccaagaaaacaaccccggtaggctgtaggtgtgttcaaggggtattttgatttggtacctatatattcttgtctttatcaattaattcgtttgtaataaattgtacttacatgttaactatttgaattagacctaaagtataccaaatcaatagagtggtgtcaaacaggcactaccaaataaaaaaaatgcctactagcaatttttattagggtttgaaaccatacaaatcctaagttatctttgtgatactattgtcgtcggcctcacccatggtttgcatatggttgaatatatctgggattttttttcacttaaacggacatctccttgttattattttaaaaaaaattgacaataaagaatattatgtaatatttcaatctaaaaatatataagtttaaatttaacttttaaaatatattaaaaataataaatattattttgaatgtctgtatactagctatagtttaatttgtttttttaataacttgtggaagttaaacttagcattattcgtgtgcgaagtgatatatatcatattaatttattttatagaaaaagaatttttttataactgtttgagtggcctaagaaaaataatggaacatcctctcgaggaataaaaattcatctccaatatatttactgtgttgatctttcgctggtgtgttatagtgtgcgtccgtcttctttttttgccttgtcaacctattacgtactgtcatgtatgttaacggacttgttagggaagcaaactgtgagtatgtcttgtttatttttcttggttttctacctaactattactatcatgtatgttagtgtacttgttagggaagcaaccatgagttaggagacatacgtaatttgttggactgttgggtgtgtgtggtgtatttttgtggctagagttaatttggatttttattattttagttctttaaaaaaattaaaatttctcattgatttttttggcattaagataattttataaaaccatgaaaatagtgaattcattcatctgtctattaccatgttttaacgattggagagcacatattaacatgaatgcattttgcacttagtacctccattgttttttttttgggatcgaaatacatcacgtaataacacctaggaacgtacgcaacatcattttcaacttttaagacccctttctccaataattgaaaaattaaacatgaaccaacctattgaacttctatgtatgtcaccatcatcgcatctcccttttaacctactccctatgtttcacattataaattgttttcggctagtcaaaattattctaatctaattaagtttataggataaaacgtaaaagcatttttaaaacaaagcaaacatataaaaatatagtaaatgatagatttaatgaaaacaaattttgtattataaatgttgctaatttttttataaacttgactaaatgttaaaaagtttgacttaagataaactctaaatggcttatgatgtgaaacctggatagtaagtccatatagataggctctggccatattggtgcatgtcaccctccaaagtaaaatcttcatttatctggccccaacggccgctcaatactttagaccaaccaaatcatttccttccatctcacggtaacaaaatgaatgatgtttttattgtctcttcatctttgcacattaaaaaagtgaaaactttataacatcattactggtaagcattacgcaacatggcactgacttcttgtctgaatgtacacaagcaacagcttgtttttataggacaaaatgacaacatattgccctgttggaacttagatgtacatttgtcatgtaaggataatattaaaatgaaatctgttgataggaaaagtgaaattttctttctaccactacctaatatgtggtcctacctatgtatacgtaagattggcacaagtaaatttggtatggaaaattgtattattatacttttattaatccctccggtttttttagtacgacgtcatgaatgttggatacatgcttgaacatttatcttatttaaaaaattagtcaattattatttgtgatattgtgatttattttatcactaaatgtatcttgagcataatatttaattcttttttatatttgcacaaatttttgaataaattgaacaatcaaatagttaaatgtatttccaaaagtaccatatactagttatgttttttaataggtaatgccgttgactttcagacacacatttgaccattcatcttatattaaataatatatataataattatcatttattttgttatgagttattttatcagtaaaagtactttaagcatgatttggaacttatgcatttgcacaaaactttaaaagtaaaacggatgatcaaatacgtgtctaaaattcaatagtgtcatctattaaaaacaaaaatagtattaaaaacagtggtggagccaccgcctgggatcatcgcagcgaacacactgtaaaatttgatatattatagaattgaaaacaaaattttcatagcaaatacttgttgtagttagatttacccgagcatcgtaaattttctagtctctgccactgattagaaatggagggaataataagtaaacaacaagtagtgtgagtaataagcaaaggtgatgacgtggcatgcaggacgtgatgttcggggggacggagacggtggcgtcggcgatcgagtgggcgatggcggagatgatgcacagccccgacgacctccgccgcgtgcaggaggagctcgccgccgtggtgggcctcggccgggacgtcgccgagtccgacctcgacaagctccccttcctccgctgcgtcatcaaggagacgctccgcctccacccgcccatccccatcctcctccacgagaccgccgccgactgcctcgtcgccggctactccgtccccaggggctcccgcgtcatggtcaacgtgtgggccatcgcccgcgaccgcgccgcctggggccccgacgccgacgcgttccgcccctcgcggttcgccgccggcgccgccgccgaggggctcgacttcaggggcggctgcttcgagttcctccccttcggctccggccgccgctcgtgcccgggcatggcgctggggctctacgcgctcgagctcgccgtcgcgcggctcgcccacggcttcaactggtcgctccccgacgggatgaagccgtccgagctcgacatgtccgacatcttcggcctcaccgcgccgcgcgccacccgcctctccgccgtcgccacgccccggctcacctgccccttgtactgacggcggccggcgaccgcggcggcgtacggcaagaatggtttgcaggtgatggtgttaaaagttcagacgcgtgtggcgccattggaggagcttggtgtggctagcttagcttcctctgggcctttttttttttgctggtttaattttcttttttttttctcctttgtaatttaatccatgtctccagaacaataagtggattagtagggtataattaagggtgacagtgtgatatatagactataagatcaaagttgtaaatttggtgtccggtgtgcctgtccacataagcacagcctctgaattttcttgtaaaactttgtcatgaaaattgagaaagaaaacacctcgctttccacgcgtacgcttaccaaactattaaatggtgtgtttttttaaaaaaaaattctatggaaaagttgcttcaaaaataatattaattcatttttaaaatttaaaatagttaatactcacctaatcatacgcgctaatgacatacctcgttttgtgtatctttttttttcctctcctctcaaactatcgggttgctatatgttattaaaacgggaaaaaaaaggcaaactccgaatgtttgttgtgaatttacatttctactaaaaatttaggaccgcatgagttgtgatgtagtggcctgagatgtgaatggggagagatcgtacagggccaaatatttccccagcggctgtacagaaagaccacctatacaacttttctcaatgtagtaatattatactccctccgtttctaaatatttaacaccattaactttttagcacatgtttaaccgttcgtcttatttaaaaattttttgtgaaatatgtaaaactatatgtatacatatgagtatatacttatatttaacaataaatcaaatgatatgaaaataattaataattacttaaattttttaataagatgaacggtcaaacatatttaaaaggtcaacggcgttaaatatgtagaaacggagagagtaattttcttaggcatcctaccagcattagtagttagagcacccgcaatggtaaagtaaggtgctatctataaaatatgtacatctcagcaatagactaaattaatagtaaaacacctcaatagtatgtctacataggtatctatagctctctaatcaattgactcatttttctctatagactatctctaagttagtagatagttttactctctcttttcatttaatctctttcaagtaggaaaatatgctgacatagggagcctatagataatcattgcgggtgcccttagtacacctgtagtctagtcacacagttgcattaatgagtagtttataatagccataattaggttacttgtaaccaacagtactgatgacgaacatatatatatatatatatatatatatatatatctgtttttgtttggtgaaacggccttttcttgtgtaagattaattcaaaattagatggcgcaggagcaggagcagaattcgttcaacgaattcactgttcagcaacgtcggccagatcagaaaacgaccctgcagaacagcagaagtggagctttcttaattacaatcttcaggcatcgaggtagctacccgaccctctagtttcatttagctcttcagagttaacattcatcatgcatggagttggttgctagtgattactccatctggtcacaatcaaaaaaaaacatgttgtcttcggcatttcttcttccagtcaagagagaacataatattgttggtgcatcaaatttaaaatggaagacaaagctatcaaccataatgaccggttgttagcttaataaggagtgacgaatacttgaaagctggctaattcagaaccttctttctaggtcggccgaaggattaggctaacctaattatattaagattgagaagtttaatttacagatacttttttaatccttgaaagaaaatcaaagtgtgataaatatgatttttttaaaaaaaaaacaatcaccctcttttctccaaattatctgcggtaaggcatgtccactttgtggccaccctccaatgccgaacctttgctgaatctcaagcaaaaggaacaagcaagaaatctctgctggaaagggaggttgataaaaggcactactccacaaatgtcagtttttttgtctgagcttggtattatttatttaaaagtagctaaatttgtaagttggttacaattgtgcaataatagtaataacttgcaacgtccgagctaatttacaattatgggtgaccatgtttcgcatcactaaggctgtgtttagtccataccaaaattgaaagtttggttaaacttggaacgatgtgacgaaaaagttgaaagtttgtgtgtaggaaagttttg

SEQ ID NO: 100 - DNA, 7710 bp, Zea mays
  source 1..7710: /organism="Zea mays" /mol_type="unassigned DNA"
  misc_feature 7039..7138: /note="n = a or t or c or g"
tgttattttgcatcactatttttaaccaatttttaagttaccgtaccaatgcacgggcacccatctagtataatatatagaaaccataacgacaaaagggcaactaactagtacacaataaattccatgggaaaattttgacgttggaggaaaacctactagtgttctaccatctaccgagtccatatcttgggtgctctgccagatccatattttgctacaattattatccttcttaatatcaggcacttcagtgttactactccatcacttctcatcgtcagggaagggataccataacctaatttcgaatgcaaatataatataattaaatgtagaaaacgagatcatattcctatcaccagttatctcaacctaatatttaattcttccaaatgaacctttgatccatctagatcatgaaacataagttacataaaaatccaacaagatacaccgatctcatacacaaatctaactggtgggaataaatagccaaaaacaatttgtatagttggcttttttaatagtacagtagtacatccaacaatcactacaagtaactgttcttttggaattatgcagtcaacacgtatggaatttgactatcaacatctctaagaatattaatttcaaatgatattttgaaaatggtatggctagattttcatcaatattaggttcaacatattataaattacaatacgttttaaacatactcatacaaattattcatagtccaagtgtttagttggctatagaaaaacaatattttgtttgttatacaaaagagtcagattctttgaaattaatatttttaaatccatacttataaaccaccggttttcacggttccacaggcgtcatatgtcaccctttcccttcttcttttatgcaaaaataagataaattattcataagtgggagtttgaatcctggttgttggctccacattaacaccatcctaatcaataaaacacacacttttgtgttttattaaaataaaatctctctatgtgatacatagaaaccgtagcaatgcaagaacatctaactagttaatcctttatgcttattagattccacctagtgcatgcaacattaggtgcataaaaacccaagagaagaaaatgtagaaaacggtaatagtcttcaattctgccaaaaaaacttacctatccagtgcatgcaacattagctgcttaaaaatccaagaaatatatgctgacgctcatatataaatccagctggttggaataaatagctgggaaaaaaacaagatgcatagttggctacttaacagtacagcagtacttccaaaaatcacaataactgttgctttggatgtatgcagtcaacatatgtcttgatcttgaccatcactgtgtcgaggaatattatgttcaaatgatgttctgaaaatagtatggctagatttttcatcaaaattaatttgaaattttcttacacaaaattaatctgtactattttttactatcagaacatatttttatgttcttttgtttaagtatctcgattgaagcaccatctcgcaccatttttaggcatgaaaaattcgtatgtcttttctgtttctcttttttcttttactattttgaattttctatacatttcaaacatactgatgcaattttcatagccaaatatatagttcctccgtgatcatttatctgtttgttataggaaagaccgaaagagcagcattccaagaaataaaagtaaataaatagatcattttatttgcttagaaatccccttttcattttcaggctctagaaatccatccgttaattaatttgctccatagtattaataagagatagagagatggggagggagatccttttcgtaaaagagaaaagaagatcctatttctatcacgctattagattatctccagcagtctctcttattctattgtatattttaaaatttactctgtaaaccgtgtctagagtttagaatgtaacatagtatttttgaacagtattagacggcacaactatctcaatttctcagacccaatatggaagtccaggtcctcacctactcctccggctatatatgaaccgtgcactcctccctttcttttcagctctactcgaagagcgttctaccaccacaccacaatctaactaaaacccaaacgaaataaaaggaagaggtcaaaaaataaaaggtgttgtgcaatcgatcatggtgaccgtggccaagatcgccatggagtggctccaagaccctctgagctgggtgttcctgggcacgctggccttggtggtcctgcagctgcgacgacggggcaaagcgccgctgccgcccgggccgaagccgctgccgatcgtgggcaacatggcgatgatggaccagctgacccaccgcgggctggcggcgctggccgagaggtacggcgggctgctgcacctccgcctgggccggctgcacgcgttcgcggtgtcgacgcccgagtacgcgcgcgaggtgctgcaggcgcaggacggcgcgttctcgaaccggccggccactatcgccatcgcgtacctgacgtacgaccgcgccgacatggcgttcgcgcactacgggcccttctggcgccagatgcgcaagctgtgcgtgatgaagctgttcagccggcgccgcgccgagacgtgggtggccgtgcgcgacgagtgcgcggcgctggtccgcgccgtggcgtccggcggcggcggcggcggcgaggccgtgaacctgggcgagctcatcttcaacctgaccaagaacgtgacgttccgcgccgccttcggcacccgcgacggcgaggaccaggaggagttcatcgccatcctgcaggagttctcgaagctgttcggcgccttcaacgtcgtcgacttcctgccgtggctgagctggatggacctgcagggcatcaaccgccgcctccgcgccgcacgatccgcgctggaccggttcatcgacaagatcatcgacgagcacgtgaggcgggggaagaaccccgacgacgccgacgccgacatggtcgacgacatgctcgccttcttcgccgaggccaagccgcccaagaaggggcccgccgccgccgcggacggtgacgacctgcacaacaccctccggctcacgcgcgacaatatcaaggctatcatcatggtacgtacacacgtcatcctctgacctccctgttgtcacgctaatcacgccaaaatcgtccgttacgttcctcgactcgtttttgcgcttaggaaaatcgtgatgtgccagagcaatgaacagtagcaacatgcatcgacgaaagaatttgaaatgataggattcgatatatatatatcctgactgagatatatatagagcatctcacttctcgtgtgtcaggatatataggtgtgatttaattctattattactaactgctatgaatggtagtattacggaatcagacgtgctttctgctggtgacagactgagtaggtgttgtcttgttcctgcatatgtgcgtaggtgctgaacgtccatatgtattcacgagctcaaagtcaaaccacacatagtatactacgccttgtctttcattcagtatactaattgtccatatgtattcacgagctagctacgtaagtaccgccacgatcgacgtgtatataacatacgtatccttttgcgatgatatttttctgtatatatacggctatattaattgtccgccctgtagtttgcacatccagcgagtccaaactaatccggccagccaatctctggtttaaatacatagatatgtcgtaatcgtaatagaatgcgtgcatgtagtcgaccttccgtcatggacacaactggcatgtctctgacgaatgtggcgtggtacagacggcgctccctacaacttttgtagtatgtatatctcattgcattgtcactaagatcttattattattatttattcttgatgaatggtcaaagctgcaaattaaaaaaaatcatagtagcaaagtgcaggtacattgatatggtttccatttataagtatagagtataaaacataatgatatatgtgttacgtggatttggagctcacaaccaaagttcaaatcccacttgtacaataattttagatttttatagatatcgacagcgtcagcgtgcatcatcgtcctgtatcatgcatccagaataaatgatacatgtgttatgttggttagttagttgagtataaatgtggatttggagctcacaaccatatagttcaaatctcacttgtacgataattttagatttttttttatttaaatatgtgggaacaccacgaccgttcatagatattgacagcgtcagagtgcatcatcgtcctgtatcatgcatccagaacaaatgttttatttctctgttagttgttgctggatcgaactatgggcctgtttgttttggcttctggcagcttctggccaccaaaagctgttgcggactgccaagcgctcagcttttcagccagcttctataaaattcgttggagcaaaaaccatccaaaatcaacataaacacataatcggttgagtcgttgtaatagtaggaatccgtcactttctagatcatgagccctataaacaactttatcttcctccacacgtaatcgtaatgatactcagattctccccacagccagattctcagaaaagctggtcaaaaaagctaaaccaaacagcccctataaatgatgcgtctctatcttttggtcgttgatggacgacgcgtgcgcaggacgtgatgtttggcgggacggagacggtggcgtcggcgatcgagtgggcgatggcggagatgatgcacagccccgacgacctgcgccggctgcagcaggagctcgccgacgtcgtgggcctggaccggaacgtgaacgagtcggacctggacaagctccccttcctcaagtgcgtcatcaaggagacgctccggctgcacccgccgatcccgctgctcctgcacgagaccgccggcgactgcgtcgtgggcggctactccgtgcccaggggctcccgcgtcatggtcaacgtgtgggccatcggccgccaccgcgcctcgtggaaggacgccgacgcgttccggccgtcgcgcttcacgcccgagggcgaggccgcggggctcgacttcaagggcggctgcttcgagttcctgcccttcggctccggccgccgctcgtgccccggcacggcgctgggcctgtacgcgctggagctcgccgtcgcccagctcgcgcacggcttcaactggtcgctgcccgacggcatgaagccctcggagctggacatgggcgacgtcttcggcctcaccgcgccgcgcgccacgaggctctacgccgtgcctacgccccggctcaactgccccttgtactgacgccatgcgcgggcgactgccattaccatcgtcccctcgggtgggtgtggggtacgggggtaggagtttggtgcctttctctgtcgtcttttttccctttaaaaaacatgcctggtcgatgttgtagggtgtgttgtagacagccattatcaattttttttattctcaattctcatgttgcgtgtgcctagctaggaagtaaaaggatcaagctgtggctgtacgggctcatcaaactatatgaaaaaaacatgtcagccacagattcctggaactttcatgcacggcaaatttcatagatatttctttggcacctcttatctatcgtgtatcccatatatattaatctctgtattaacaaaattggagcttcctcacgtacgcacccaggcactgctcaccaccgtttaagatacagctcaataatgttcctgcactgtttaatattgtattgtatatcattgttgcccgcgctaaatatatgtttactgtttggcaacatatctagtgcacatggactgctggtgcacatcatacatatattaaatcctaccctttcatctaagatcaagcgtctcacaattatctcacctctctctctctcctgcctttttgctaaaatgccctcccgcctctcccacttcctaccatgtcgttttttagaaagctgcatggcggactgtttatctgcttgatcagaacggctgggagtatgcaggattcagccgtgccagatttttttgcttcctccggtcaatagaatatgaatgtatggtgtagatgaatatatagtggcgttttcatgcaccaacagaatgaacgaacaagatcaatgagcaaagaaactgactacatctagtacatatatcccctattgttctctctccatctttctctgtctctcaaataaaatatgagatatcaataaaaaactaaatatgctctaactttttgaccaatgatttgaagccgcagctcaaaaacaaaaaataatatgcaatagatcagtaaatctttcattgcaccattttcgatcaccatacctatgtaccacagtcttgtatatgatgacattgtaagatacatgtcatccaacaaagagaccgttgattctaaatcgccctggacagaaaatccataaattagaattacaaaattaacaacatacgaaggtcatccgtggtgatcgtgacggcgccaagtgatggtgatcgagcctttgtaggctccctctttggcgagtgtctgctggactagtggtcgacaaagaaggctcccgtggccccctttgctagtctctttgtcgagtgctccaagaggcactcggcaaagtctctctctttgccgagtgcttactcgactaacggtcggcaaagggagcaccagtgggcccctttaccaggccctttgtcgagtgctccaggaggcactcgacaaagattgtttttttgtcaagtgtaacactcgacaaagtgactagaatatctcattttatttgtttttattattccatccaaacaaacaaaagatatatcacgaaattatcacatatatatcatagatatcacaaaaatcatcgcatacatcgtacacgccacatatctcacaaagaccacaaatctcacaaatatcaccatatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtattagatatttcgtcacaagtttcagacacaaacataagtctccatcactcacaaacatttgtctcaagtatctcacaaattattaccaatgacaacaagttcagaccaagttatctcataaagtattaacaacaccaatagacataagatcgtgtgcacaaagtatctcggcaaggtggagggctggactgattcggcgataggttggacgatccatgagggttgtttgatgccaacgtttgtccctatacagagaagagattgcatgtgtgagaccagataaatatatatcatgcagggctggaactttgatactcacataagtatataactgagtagggttagcttgagggaacaacgaggtggtggaacaaaaccatgtgcggcaccaaggctctgcatgtactgaaacatcttcgtcattcttgatccgccaagcgagctgcctgctccgcctcccactccgccctcatcctcgcctccatctccatctgttccctcctctcttcttttagctaggcctgtaatatttcacccaatgttataataatgcaaagagaaggtat

SEQ ID NO: 101 - DNA, 7353 bp, Zea mays
  source 1..7353: /organism="Zea mays" /mol_type="unassigned DNA"
taaaaaaaaccgccagtggaaatagcatttccactgacggttttcttaataaaaccgccagtggaaatgctatttccagtggaaatggcgattttactggcggttttagaataaccgccagtggaaatggcgatttccactggcggcactgaaaaacgccagtgcaaacagctctagaaccgccactatagagcctctgtgtactagtgttaaagtaaaatccataattttgtaggatcaatatccttgttcccatagtcaattgtgggagtactccttgtctcctactcaatccactagtagaaaaaggcttaacacctgcgggacgatatatttttacagacggatccggttatccaccgactgtgctatttctagtggcggttttcttaaggaaccaccactagaaatcatttttatccttaatttttcgaatttttcaaacgacctcgtatgacaaaaccaccaaaataaaagttgtagatctctagaagttatgaaactttgtagttgacaacttttttatttgaacttatttcggttctcaaaaattgaatctaagtatgtcaaatttaaaattcaaattttgcaaactacctcggatgaaaaaagtgtcaaaataaaagttgtagaacttcaaaagttatttatctttgtagttgacaacttttttatttgaattcgtttagggtctcaaataagcaatttacactcaaatggttgtaatatgtggagaaaacaactacaaactagacacaaagcatgtcatagacggagtggtagtggagggtacgcgcgaggtcgacgggtcaattactaacaaccgcgtagcgcgcgaaaaatgccgtgacttgcgacttcggagacgggcgggtggggtgggcctaataaaaataaatttttttactatttttaaaatctgttttatgttttctggaaacgatttgcactggcggtattattacgtcgatcgccagtgaaaatcgattttcactggcggttttattatgtcgaccgccagtgaaaatcgattttcccgcctgtaaaaatgatgatttttactagccccctagcactgacggttacgataaacgccactaaaaataggtttacgaccgtcagtatagatcttctctatactagtgatatccctttctcatgtaactccatttcaaatgaaaataaagaacaagtagaaaaaaaaatgaaagagacccaattcttgtcaccattattaggcacagttaactgatcgagttttcaacccaatgtatccctgggtcctcacctagagatggcaatgggtacccgcgacccgatacctgatgggtatttactccattagggtatgtatgtgggctaaatattctacccgtgggtctgttattgggcaaaaatcttcacccaatgggtaaacgggtattagaacgttccgccttcacccatacccgttaacccgtgggtataaaatacccaatataaacttatccgaagcatgaacttggactttagtcatccaacttttttactatttaataacaatttaatgaccatgtaatggaacatgtaatgtgctatgtagtactatcatagtgttactactttatccaattatctttggtgtgttgaatggatggttaaatgatgctagaaaattttgtaatggtatttatatggatatacttgccatttgtatagtataattttttgatagttgtttaatttttgtgggtacgggtgacccgatgggtgacccatacccacatgggtatgggtatgggggtaaatctatacccgccagtgtatatgggtgacccggtggggttatttttgtgtcgtgggtatgggtatggggtagtaatacccggtgggtatttacccattgccatctctatcctcacctactcctccggctatatataaaaaccgtgcacctccccccttgtcctcagctctactcaaagagcgctctaccagtacaactacaaccacactaaaacccaaacaaaaaaaaggaagcaggtgctgccgatatatcgattgatcgatcatggcggcggccgtggccaatatcggcatggagtggctccaagaccctctgagctgggtgttcctgggcacggtgtgcttggtggtcctgcagcagctgcgacgtcggcggggcaaagcgccgcttccgcctgggccgaagccgctgccgatcgtaggcaacatggggatgatggaccagctgacgcaccgcgggctggcggcgctggcggagacgtacggcgggctgctgcacctccggctggggcggctgcacgcgttcgcggtgtcgacgcccgagtacgcgcgcgaggtgctgcaggcgcaggacggcgcgttctcgaaccggcctgcgaccgcggccatcgcgtacctgacgtacgaccgcgcggacatggcgttcgcgcactacgggcccttctggcggcagatgcgcaagctgtgcgtgatgaagctgttcagccggcggcgcgccgagacgtgggcggccgtgcgcgacgagtgcgcggcgctggtccgggccgtggccgtgggcggcgggagcgggggcgaggccgtgaacctgggcgagctcatcttcagcctgacgaagaacgtgacgttccgcgcggcgttcggcacccgcgacggcgagggccaggaggagttcatcgccatcctgcaggagttctccaagctgttcggcgccttcaacgtgggcgacttcctaccgtggctgggctggatggacctgcagggcatcaaccggcgcctgcgcgccgcccgctccgcgctggaccggttcatcgacaagatcatcgacgagcacgtgaggcgcgggaagagccccgacgacgccgacgccgacatggtcgacgacatgctcgcgttcttcgtcgaggccacgcccggcaaggcgacgggcgccgccgccgctgctgacggcggcgacgacctgcacaacaccctccggctcacgcgcgacaacatcaaggccatcatcatggtacgtacgttacgtatacacacacgtcgtgctgtgcaccatccctcgatctgacctgctgtcagtcacgctaatcacgccaaaaccgtccgttccgagttccgacgccgggaggactgggtgccggccggggttcgggcctcgggagcactgaatcaaaacgcttggctgaagaaacccgtaaacaaaaatacttactatatatatacctaaaatgtgtgacgacgtgtgatgtttgacaaccaaccaatcaggagtgctttgcgtctctgcatgctggtgacaggtgtttgtcgtgttcctgcatgcacgcagcacatgtggatctcttcgcccgccacggagctagattaagtcagggccacgtgtgcgtaactcgatctccagtagtgcatttttttcttcggtttggagttctcttctaccccggccggcttctacgttgacaagctccaaccggccggccggccggcttccagaaaagcagtacgtgaacgtgacgttcggtaggtgtacttgttatttgtttgtgtcgtcctccttggtgtctggagatcgagtcgattagccagacagaccagacgtagccgcgcacggtcggcttgcttgtgcatggtgagacacgttttctcttttttgttcatacatgcatgtagtactgtgcgcatttaatttgtggccatgcttatgagtcgtctcacactagtactgtacgcatttttaatttgtgcgttggtggattttttttctccccatatatcacgacacgacgcacaaacatttgtctatagtccaactttgcgcgtgacgtaagtcggtcggtcgtcgtacaaagtttggacggccggataccctgcatcgatcgttctccaccctatatacggagctgaaagtaggtaaacgtgatgaaagcatccgagtttgatcgagctagccaaccattggagaccatgcatgtcacttttcggtgcatttttttcgtctaagatagctctgtccaccttggtgcctcggtgcgtgcatgtcaccttccaaagtatataaaaaaaacacatgcatcacccattttctgcagtatatatataaccgcgctagctgccgtaaatatcttgcacaattaaaccgtcatgatttcgcttgtaattaataatctagcattctagcttccgtcatgggcacaactagctagcatgtgcatatatgactgatatgatcatgtgtggcgtggtgtaattaatattcactaaaaacatcataaataaagggtaatatgtacctcaccatcgcgtcgttatgtattttgttgttttttatgagcagtcaaagctgtaaactaataatgatgtatggacgccgcatgcaggacgtgatgttcggcgggacggagacggtggcgtcggcgatcgagtgggccatggcggagatgatgcacagccccgacgacctgcgccgggtgcagcaggagctcgccgacgtcgtgggcctcgaccgcaacgtgagcgagtcggacctggacaggctccccttcctcaggtgcgtcatcaaggagacgctccggctgcacccgcccatcccgctgctcctccacgagaccgccgacgactgcgtcgtggccgggtactccgtgcccaggggctcccgcgtcatggtcaacgtctgggccatcggccgccaccgcgcctcgtggaaggacgccgacgcgttccgcccgtcgcggttcgcggcgcccgagggggaggccgcggggctcgacttcaagggcgggtgcttcgagttcctgccgttcgggtcgggccgccggtcctgccccgggatggcgctcggcctgtacgcgctggagctcgccgtcgcccagctcgcgcacgccttcaactggtcgctgcccgacggaatgaagccctcggagatggacatgggcgacatcttcggccttaccgcgccgcgcgccacgcggctctacgccgtgcctacgccccggctcaactgccccttgtactgacgccctgcacgtggcgcgcggggactgccattacgcatgcatgcgtttggactttggtgttcatccctggggtggggccgccgtgggggaagttaggagtttggtggctttctagctctgtcttcttgtattctgtttattataaattttcccaacccttccatgcctgatcgatgtgcggtaataattgttagaaaatgtgacattttgtatgtaatcaatctatggggtgcaattgttatctcgtcaaaggacacaccactcgacttgcaccccttcatgtatatatatacatacacgaacatcccctgcaataaagaaatcgctgtcactttctttcgaactcctttccactgttttacaatatgttatcaacatgtgctcgcgagaaaatagtgagaagagaaaaatgctcgctgttttggagaagaacggaggcccggcctcaagatcgacgagaaatatgcatcatatgatcaactcaacggaggatgaattatacattgtggacagttgtaccacaaactctatacttagagagatcaaatattttcagactcttaaaaatgaagatgaaaaagttttgaccatcgctggatgcgatgcggtgatagttagctctggacaactattaccctctccatgggtactaaaattgttatcggagatgcactattgtatcctgatcccactcgtaccctactaagttttagagatatgctatagatgggttctatatttaaacccatgatgaaaatcaagaagagtttctctttttgactaagccggacagatatggcaaacgcatatatgacaaaattttattactcacgtctgggttgtactatacattcattaagtacattgcacatgttgttgcatataaggtgatttttcaaaattggttatcgaggcatagggattatgataaaaatcacaggcaattctattggtcataatttgtccataacaaattttcttaaatcgaaagattttatttgcactacatgtgcaactgggaaattgattttgagaccatcacatctcaaaattaaagttgaaccgctaaaattccttgaaagaatttaagtaaatatttgtggatcaattacaccaactttcgggccattcagatacttcatggtattgattgacgcatctactcgatggtcacatgtgtgtttactatcaacacgcaaccatacatttatcaagataatgtctcaaattatcaaattaaaggcaaattttcctgaacatcagattcaaacaatccggatggacaatgccgctgaatttacatttcaagcattcaataattattgtatggcactggatattcagattcaacactcggtaccatatgtccataaccaaatggtttggatgagtcactaatcaagaggattaaacttattgcaagaccattgttaatgaattgcaaattgtcttcgtcatgttagggtcatgcagttctgcacgctgtcgatcttatcgaactatgacctactgcatattatgctacttcctcaatacaaatggtacatggaaaatctccaagtatttcctatttgtataaatttggatgtcgtgtatacattccaatctcaccacctcaaagaacagtcatgggcccacacaggaaagtggggatctatatgggatttcaatctccatcgatcataaaatatttaggactcttgataggagccctaaggcagctaggagccgttgaagctccatttggtagcaaaagttgccttctgtacgtgggcgcaccggacatgaatagtgcacgatctccttccttatttagtgaagccgaccgttgcagccagggtcctcttggcatactggacagtccggtgcggcttgttgaccgttggcgctggccacgtgtcgcccactgatttcgctgccgaccattggcacgggcgctgctggctcaccggacagtccggtgcacaccggacagtccggtgaattttagccgcagtgtccccaacaaatcccgagagcagcgagttcaccgacgtgctccagtctgggcaccggacactgtccggtgcgtaccggaaagtccggtgcacccgtaggctggtgcaagtctggctttttcagccaaacttcttttgctcctttttgacttgacttaactgagttcctggtgcttagacaagcatgtttagctcataaaacatatgactaagtgtctagaacttaccttcatacttgatacatctagattgcttcatatacttttgctcaacatcatgtcagttctcacatagtgtgttgtgcatctaatcatcaaaacaatatagaaatggtccaagggcac

SEQ ID NO: 102 - DNA, 7394 bp, Glycine max
  source 1..7394: /organism="Glycine max" /mol_type="unassigned DNA"
atgatcattcacaattaatcacatgactaattatgataattaatcacattcttggtatgtgaaataaaatagtattcttattttatgagcaagttccacattcataaaataatactccatttttatattaattatattcttggtgctagtaaaaaatataataatatttcactaaaatatttatttgattaaattaaattctctaatttaattatcaaataaattattttcttttgtaaagattagaacactcgtttatatgtaaccccgtaggtttaatactaaactggtagtaaattaatcataattaatttactaattaaggaagacgtctagcagcagtccattaagtccaagcatgaagtaacatcttttaccttcaagaacaattgaagaataatgtaatatttcatttcattgttgtttataactcaaggttaattctaaagtataatattattatcaaactctaataagataatacatttaatcaatgaatgacttaagaaactcttttttctttcattcaattgtcatgtctaagatcttaattctatcatagagctcaaacttgttacctagagttggtggattccttcttgattaataattaattctataagtatttaatcatatccaatattcattaaactagtgccttaagacattaagtgtctaaaatttaaatataacaaataatttgttaactattatgataatctcatgtcaaaggaaactattatatttcttcttgagaactttctattgatatattaagataatattaactattaggaattttcaattaagtcatttcaatgatgacatccatatatatatcatctatatatgcaatttaataaataatatttattaatttttatctaataaagacttttacatatatattaatttatctgaattattgatgtcttattcataataatcttacgattaagaataatttatattaaaattataaaggaattatttatcattatcataatcttgatcatgataacaaacctctaattttaattttggacttgtcaattctactggaatttttttaaaaaagatgagtgcattgcagtatggcagaaaccttctcacaatagctgctatatttttgcatgttagctagtgattttaatagttagttttgggtgttggtagttttctagttgtaatttttgtggattctttttgttgatatattccttaaacatgattttaatagccttatcttttaataattgtgctgtaaatgtactttaaaaaattatatctaaaacggatcgattagaacttttttcattaaattaatttttttaaaaaaatacattctaagacagtttttttaaaaaaaccttcttagaaagtctattttttaagatagtttttggaaaaatcatcttaaaatcttcaaattttttaatttttttgttttaaaaaacacattctaaaatggttttttgaaaaaaatcgtcttagaatccttattaattttttttatttttttaaaaatgattctaagacgattcttttaaaaaccttcttagaaggatatttttttctaagatgatttttaatggaaccgccgtcgaaagtcaagattttcgatgacattcgcttcgaagacaatcttgagtcgtctttgaatgtagttatgaatcgtcgtggaatgatgcttttgcagtaggttacaaaattatttatcatataatattaaaatatataataaatatttactatatttattaaaatctatttattatttaaatatacttatttgttaaatatttataatatatcaaatatgatataatacataagtatatttaataataataaatatttgcctataacatgaacacagcaaattagaatatatttttctttttgttaagaaccaaattagaatttaagaaactaaaatcatgcaaatataaaagtttggaaactaaaattatataattaatggtccagatttttgcaaataggtaatcctgaagctgcaaaggcaggagatcagatccctgtctccgtagtatcttattatatttaatatttaatatataattaattagaacgtccacgtttaataagtatcttgcaggaagaagaaactgaagtgtatatataggtccccatgacactcccctcaactcagcaacaacaacacttacttgaagttgtgctattcaatcccaaagccacagaaataatattattcagattttagagactgaaaacatcatggccaacctcgacctcgacccattccagacaagcatcttaatcctcgtcccaatagcactcctggtggcgttactatctcgtactcgtcgaagagcaccctacccaccaggcccaaagggtttaccaatcataggaaacatgttaatgatggagcagctaacccaccgcggcctcgccaacctggccaaacactacggcggcatcttccacctccgcatggggttcctccacatggtcgccatctccgaccccgtcgccgcgcgtcaggttctccaagtccaagacaacatcttctccaaccgcccagccaccatcgccatcagctaccttacctacgaccgcgccgacatggcttttgcccactacggccccttctggcgccagatgcggaaactctgcgtcatgaagctcttcagccgcaagcgcgccgagtcctggcagtcagtccgcgatgaggtcgacgccgccgttcgcgccgtcgctagcagcgtcggaaagcccgtcaacattggagaattagtgtttaacctcaccaagaacatcatctaccgcgccgcgttcgggtcgagttcccaagaaggccaggacgagttcattaaaatactgcaggagttctccaagctctttggcgcgtttaatattgcggattttataccctatctcgggtgcgtggatccacaaggtttgaactcgagactcgctagggcacgtggcgcgctcgatagcttcattgataagatcatcgatgagcacgtgcataagatgaagaatgataagagcagtgaaattgttgatggagaaacggacatggtggatgagttgctggcgttctacagcgaggaggcgaagttgaacaatgaatcggacgatttgcagaactctatcagactcactaaggataacatcaaggctatcattatggtatggattcgtattcaaattaatatactatcttattcttatcagccacctaatgaaattgataattcgtggcatgaaagtttacgcatttgactatttcattaagagttgttaagaacacggtttttctcaaaaaccacgtaagcacgtacaacgccaatacctcgatgattggatgtcttttggaatcctttctagtttaatgagattttttttaattgagaaatctaatttcttacatgattttttcaatgcaagaagagaagattcagatcaataaggtttatgcatgattatagaaaaattggatgaatttaagcttttaaaaagtttatgtatttttttaaaatttaatgtaatattgacatagagtattactgattttattaatgattaattttcgttaaaaaatttggttaataaaatttcttattttaatcagatttattctgcgtataaaatttaaatttaaaatcttacttaaacttttgcttaattaatttaacaaacacttctaaaaaaaagaaaacatattaagaataacaggtaaaatgctttaaaagtggttctaccttgagtttatagtgaatatgtgtaaaaatatccacttttgtatatcaaattataatagatgcttttataaaataaaatttaactttctagtatattttcttcaaaggatggttaatgttatttttaaaatttgaatttagatctcttttaaattgattgtatcttttttataatttgaatattttttaatttatttaaatgttttttaatttttaccttttagattttatttaaatttcaaaatgtcaacatatgttacatgaaaacttgctaaatacataagtgtttgcatgcccgtcagtaattttggttagtgaagttttaatttgtcaaaagtttatttgcatgtctaagatataaattatctatttaatattttctcaaatcatacaaccacctcacatttacatgtgatcatatttagtttacttattaaactgatcagagttcatttaaaaaacaaattgtcaacactacaaaaaaaaaaaagtctccaaatcaattatgattacttatgccgaaattgaaaaagtaaaagcagatttactatagttattatggactagctggagatgaacaaataaagtagataagatcataagattgagaataagatttgggaacactagccaccaaaaatgcagtgagtgactatcccaacgtgatcatagtgggtttgggtacggttggtgtcatttccccgtccaaatctacagcttcttctctttatttatttttttcaattaaagtttgattttagaatgcaaaattcaatattgtgtcgtatgaaggtggtaagtaaataaagaaaattgatatcggtgatgattgtttgtttgtggtgtgcgttaacattacaatttacacaggacgtgatgttcggaggcacggaaacggtagcgtcagcgatcgagtgggccatggcggagctcatgagaagcccagaagatcaaaagcgggtccaacaagagctggcggatgtagtgggcctggaccgtcgggccgaagagtccgatttcgagaaactcacttatctcaaatgtgccctcaaagagaccctccgcctccaccctccgatcccgctcctcctccacgagacggcggaggacgcgacggtcggcggttacctcgtccccaagaaggcgcgtgtcatgatcaacgcgtgggccattgggagggacaagaacagctgggaggaacccgagagcttcaagcccgcccggtttcttaaaccgggcgtgcccgatttcaaagggagcaacttcgagttcattccattcgggtcgggtcgcagatcctgccccgggatggtgttggggctctacgcgctcgagttggcggtggcgcacctccttcactgcttcacgtgggaattgccagatgggatgaagccaagtgagatggacatgggtgacgtgttcggactcaccgctccaagatccacgcgactcattgctgtgccaaccaagcgcgtggtgtgccctctcttttaaaaaaacaacaatttggatcttttttcttccttttttttgtattttctttttatccctcaattatacataatcatattaaaataatataaagggaaaaaaggcagctacacaataagaatgtgggagtatttggaagaaaaaaaaattgtaaacaatcaattatatgcattttgttatttttgccccatttccgttttgattcttatatacgagtagagtaatgatggagtcattctttttaatactctttcttaaagacttttttatgattaattataattcattaaacaaatattaattttgattgatcttgtttttgatttaatacaaataaggagaatgaatcattaaataagaacaaccaaaaataatatttttaaataaattctaattaatcataaaaaaatcttaaaaaaagagtgtcaaagatagtacatctctcttacatattaacagaaataaaagtgtaccggccattaaaagagtcagtagctatggtggcataatggcatgttaccaataattgttgtgacaaattaagttgcgcgattgtggtaatttagtttcattttttgtcttcgatgcgacagtgaataaattaccacaagtgcgtaccatggggaatttatttttgttgcggggatttcacatcaaatcacgtatttaacagtggtagtattgttttctaagtgggttctagaggcgaagttgatgacttttgagtgtgaaagattgataggaaagtgtagctattattagaaggggcgatacaaatcaacaagtgtcccaaaaatcaacatcgctcaggttgattagtcctgaaaatatatataacgatgttgaaatgcatggaccctgcgctataaattgctttcctaattgagtttgagcgtggcaatggcaatggcaaaagaattttaagaatgcttgctcactgacgctgcttctaatgggaaagactttttctacatgcatatgttttaagaaaaagaatttatcgtataagaaaaaatctagggcgaaaaataagttacattaaaagcttgacatgaattaagggtgcccatgtgagtcagctgttaacatgagatgaaaatttattgaacttatcttgaatttatgtagttaattagatttgtcggtgcgtattccgaatatggaaaagtggcagtaatttgttttatataagagaaatgattgaaggtgcagcgtggaaaagtatatttcaaagcgtatatgtaatggcgtgtaatatcgaaacagaaagatgaatgagtagaagccgaagagtttaggtgagtgttaaaaagaaccaggggccattctctgattttattcaaattcaatatcagaaaatgaccctcgttgggcccttattttgtatccataagcaaagtcaactgaggaactcttccggggttgcaaagctttaactactttgtgataccaacacagactacacttgtatttaaggtccgtttgtttgactattttgcttctgaagaagaaaattctaccactcgtttcacacaatgcttcttggtcagcgtgaacactcgttgttttcagacgtagaatctcaaacaagttaaatcggcagattatcatttgcttatgtgtgtcttgttaaggtgtgaagttattactctttactagacagttagacataaatattttcaatttgctggttcaatcagacaatgtgaacaaattccataaacaatcaaattttgatcaccattaacctaaaaacaaaacaataaatgaggaccgcccaattttgtgtttagtttattagctaaataaacccgtggaaggcctgcttatggagtcatggtcccatgccaagattttcttttgttgaatttagagtagatttgaagagagacagagagagagagagacaaccgaatcttttggagagaatgcataaaatgaaaaaggctttcttattcttgtaaaatgcagtacaaagattttgcatatcatttatatgaatagtagggtcagcccaacaaattttgttggactaatacaaattctatattttaactaaggaacaattaaactaattctttaagacaaaagcacatactagtactagttataattgtcatatgtaacagatgatgaaaaaattataaa

SEQ ID NO: 103 - DNA, 7394 bp, Glycine max; identical to SEQ ID NO: 102
  source 1..7394: /organism="Glycine max" /mol_type="unassigned DNA"

SEQ ID NO: 104 - DNA, 7224 bp, Glycine max
  source 1..7224: /organism="Glycine max" /mol_type="unassigned DNA"
cttaattgaatttgtcattctcctccataatttactcatagctatttgatggccatcatttgaagagtaaaaatattgatttaaaaattactgatttttttattacaaatatgatcaaatacattaaaaaaacaaaatactggttttgaaaatagtaaataaacaaaaggccttattatttgaagttttatataatgaataagaattattaaatactcttcattttaaaagtataatttatttaattatacttttattttattaacattttgtcattctactagattgacatacaaccgcggtacttttactaaatgctctgaatttaactataataatgactcatttttattaaagcgaaaagtaattcaaataacatgaactttttgaaggaaaacaacatcactttaggtactgtttgtactatttttcaattaaaattaaagtttctcagtaatttatattgtattaaaatattttgtagattatcaagaagaatcattagcaaaaacatacatatgatattgtacctaaggtttctccataggaattcagttttttaaagtcaacaaattttacaatttttttacaactttagagttgacctaatatttatccaataaatgtactacaaactttcttgaattttttattcctgagtgggccaggaactttcttgaaattgtataattttaaaacgtaataaatactttcttggaattaggaatagttgggagtactatgtttttttaaaggaaagttggtaccactatattagattttagttgtttcaaatttactaatttaatttgtttaaaattattataaatgtgtttttaattttaaacttttctatatattataagaaagtttaactaacttctatactaattaaaaaagttaaataatattccttttatctttaaataaatatcacatttgaaaatattatctcaaaataaatgtcatacatgttaattttttactttaatattaattttttattaaggttaattttataaaattattaatttttcatttatttattattttttcttaatttatataaaataatttaaaatgacacttattttaagataaaaaaatataatattatattaatatcatgacattgatttggagaatctcattgataacttttaacttatagaatctcatttccaaccttatcttttaacatacaaggctcaaattaacttgacatctttcacaaggagattgagtttagttattagttaatattaattatttaattttactaattatatttaataaataatttttcttaagagctcttcattggaattgataaaaaaatagttattgaaaatatatattcaattaattgaatgatatttttaggataatattattaaaaaactaaaatagttaaaacttaattatatttgagttcatcatatcttttttattgtttataattgactccggaggtgctaggtactttcttgaaattaggaatagtttgagattaagaaaaataaagtgaaatgtatttaaggaatatttatcaaatatttattataaatattaagtaataaatgtaataagtatttcttataaatattaagtaataaatattcattaaatatattagtattttaatactaaatatgagtaaaatataataaataatcgtaaatatttattatttaaatatacttacttactaaatatttattatataatgcataagcatattttaagtatagttaataataagaaatatttggctataacattaacacaccaaattaaaatttttttttatgagaacgaaattaaaatttaagaaactaaaatcatgcatttataaaatttaaaagagtaaaattagacgtatacaattagtggtcgagtttatttgaatcggtagtatctttgttattatattaaattaattagaaacgtccacgtttaataaatatctgaagagaagaaagtgtatatataagtccacatgagactcccctgaacccagcaacaacaacacttacttgtagttgcgaaatcatccaaacacattccatctattaagattttagagagtgaaaatggattggcaaagcatgatgggcaacctggacccattccaaagaacaatcttaatcctcgtcccactaacactactcctgctgctgttactatctcgtacccgtccaagaccgccctatccaccaggccctaagggcttcccaatcataggaaacatgtttatgatggaccagctaacccaccgcggtctcgccaacctggccaaacactacggcggaatcttccaccttcgcatgggcttcctccacatggtcgccatctccgaccccgatgccgcgcgacaggttctccaagtccaagacaacatcttttccaaccgccccgccaccatcgccatcagctacctcacctacgaccgcgccgacatggccttcgcccactacggccccttctggcgccagatgaggaaactctgcgtcatgaagctcttcagccgcaagcgcgccgagtcctggcagtccgttcgcgacgaggtcgactccgccgtccgcgccgtcgccaacagcgtcggaaaacccgtcaacatcggagaattagtgtttaacctcaccaagaacatcatctaccgcgccgcgttcgggtcgagttcgcaggaaggtcaagacgatttcattaaaatattgcaggagttctctaagctctttggcgcgtttaatattgcggattttataccctacctcgggcgcgtagatccacaaggtttgaactccagactcgctagggcacgtggcgcgctcgatagcttcattgataagatcatcgacgagcacgtgcagaagaagaataattatcagagcagtgaaattggtgatggtgaaacggacatggtggatgagttgctggcgttctacggcgaggaggcgaagttgaacaatgaatcggacgataatttgcagaactctatcagactcactaaggataacatcaaggctatcattatggtatggattcgttttcaaataaatatatcttattcttatcagccacctaatgaaatcgataattattcatggcatgaaagtttaagcattttactatttcatccagagtatttaagataagagcactgtttttttttctcaaaaaccacctaagcacgtacaacttaacgccaatacctcaatgattggattgatcttcagcttatctttggattaatttctactttaatactttaatgggatttttttattgtgaaatctaattgttaaatgttttttagtgcaagaatattaagatctataaagtttaatttattgatgttcatagaaaaattggatgaagaattaaccttttaaaaagtttatttatttcatctcctatacattttatatttttttattggtgtttattaagaagttgtccaaaaagacttttactatttttaattctttatcgtccttcaccttaaaaagaaaaaaagtggctctaccttgagtatgtataatatattgggaatgtgtaaaaatatcaacttttgtttgctaaattataatatattttaaaaaaatttactttctgtaaaggctggttgaattcgtgatattcttaattttcaattttgaatttacattttttaaattagatatatgtatttttaaatgcttttttcaaacattttatacttcatttaaattaaaaatatcaatatattatacataaaatgcgtgttaaatattttttaaaccttttagttgtatagaagtatttgcatgtctgttagtcatcctaaattgctttgtttggaagttttaatttgtcagaagttgatttaagtgcctaagttataaattttctatttatgtgtcatcaatatgtagtttacttattaaactgatttgagttcatttagaaaacaaattttcaacatttacaaaaaaatgtctccaaatcaattatgattatttatgccgaaattgaaaaaagtaaaagcagatttactatgattattatgggctaactggagatgaacaaataaggtagataagatcataagatttggaaacactagccaccaaacatgcagtactagtgagtgactatcccaacgtgtttcatagtgggtttgggttggtgtcatttctccgtccatatctacagttgcttcttcttctctctctctcttttttttttttgtttcaatcaaagttttatttttgaatgcaaaattcaacgttgtgccctatgaaggtggtaagtaaataaagaaaattgatatcggtgatgattgtttcatttgtttgtggtgtgtgttaatattattacactttacacaggacgtgatgttcggaggcacggaaacggtggcgtcagcaatcgagtgggtcatgtcggagctgatgagaagcccagaagaccaaaagcgggtccaacaagagctggcggatgtagtgggcctggaccgtcgggtcgaagagtccgatttcgagaaactcacttatctcaaatgtgccctcaaagagaccctccgcctccaccctccgataccgctcctcctccacgagacggcggaggacgccaccgtcggcggctacttcgtccccaggaaggcgcgtgttatgatcaacgcgtgggccattgggagggacaagaattcctgggaggaacccgaaacttttaagcccgcccggttccttaaaccgggcgtgcccgatttcaaggggagcaacttcgagttcattccattcgggtcgggtcgaagatcctgccccggaatggtgttggggctctacgcgcttgaattggcggtggctcatcttcttcactgcttcacgtgggaattgccagatggaatgaaaccaagtgagatggacatgggtgacgtgttcggactcaccgctccaaggtccacgcgactcattgctgtaccaaccaagcgcgtggtgtgccctctcttttaaaaataaaaaaaaaacacttggatctttctttttttcctctttgtattttctttttatcccttaattatacataatcataataaatgatataaagggaaaaaagggaggtgcgcaataagaatgtgggagtatttggaagaaaaaaatttgtaaaactcttcttgatcattgatgtgagcttttgtgcagaaacaattaattatgtatgtattttgtttctttttgcctcacttccgttttgattaaaaaactgaaataaaagtgaaccggccattgaaagaatcagtggttatggtggcataatggcattaccaataatttgttgtgacaaatttttgtcttcaatgcgacagtgaatatgcaagtgtgtcccatggggaattttatttttgttgcggggatttcacatcaaatcacgtatttaacagtggtagtattgttttctaagtaagtgtattctagagacgaagttgatgactttggagtgtgaaagattgaaaggaaaatgtagccattattagaaggggcgatacaaatcaacaacgagtgtcccaaaaatcaacatcgctcaggttgattagtcctgaaaataaatataatgatgttgaaatgcatgggccctgggctataaattgctttcctaattgagtttgaatacgctgcctctaatgggaaagactttttctacatgtggcagtaatttgttttgtatacgaaagtgcatagtattataatagaattgattgaaggtgcagcgtggaaaagtatatttcaaagcgtatatgtaatggcgtgtaaaatcgaaacaggaagttgagagtagaagtcgaagtgttttagtgagtgttgaaaggaacgtggggccattcttcgattatattgaaattcaatataaaaagttaaaaccgtgaaaatgacccttgttgttgggcccttattttgtatgcataggctaagtcaactgaggaactactccggggttgcaaagctttaactactttgtgataccaacacagactacacttatgtttaaattaaaagccccgtttgtttgactattttgcttctgaaaaacaaaaatctggcactcgattaacacaatgcttgtttgtcagcgtgaacactggttgttttcagacatggaatctcaaacaagtcagcagattatcatttggtgacatgtgtctcgttaaggtgtcaagttattactctttactaggcactagacagtcagacataaatattttcaatttgctagttcaattcaatcagacaatgtgaacaaattgcataaacaatgaaatttgatcaccattaacctaaaaacaaaacaataaatgaggaccgcccaattttgtgtttactttattagctaaatataaacccgtggaaggcctgattatggagtcatggccccatgccaaggttttttttgttgaatttagaatagatttggagagagagagagagagagccgaatcttttggagagaataatatataaaatgaaaaggctttctttcttattcttgtaaattgcagtacagagattttgcatatcatttatatgaatagtagggtcagcgcaacaaattttgttggattaatgcaaattttgaggtggagcgtaattatgtcataaattcgattaatgcctatattttaactaagggacaattaaattaattgtctaagacaaacacatactagtactagctactataattgtcctatgtaacaaatgatgaaaattttatatgaatacattcttgtaaaatgcagtactaagattttgcatgctaccatttatatgaatagtagggtcagcgcaacaaattttgttggactaatacaaattcaggtggagagtaatcatgacataaattcgattaatgtttacattttaactaagggacaattaaattagttctctaagacaaacacatactagtactagttataattgtcccatgttaacaaatgatgaaaaatttataaacactacaaccagcttcccttatttttagatattcaagactaatgggcacaaatattcatatacgaaatgtatcaagtgagagactttttatatatgagaataggagaaatgaatattaataattagatcttgtcatgaatagtcaaaattaaactaaacaattttttgagttttaaaataatcgccttacattaaatctaattcctccacaaataattacatggccttagct

SEQ ID NO: 105 - DNA, 9459 bp, Glycine max
  source 1..9459: /organism="Glycine max" /mol_type="unassigned DNA"
aagttggatctataataagagcacgaggaagtattatataagacacattgaattttgatatttatgataatgacaataattatatattaataatttgaatttaatggttatgtactatgtaaaaaaatttatatttttaaaccataaaaaagtattgttggtatgataattaagataattattataaaaataaataaaattattatatataattgttcataattgaatgataatgtaaaactttacataaggtattttctttaataatttttaaaataccatcaaagttgtacactacatatgtaaaaaaaaaaagtaaaaatatttgtacactgcatataattataaatgataagtgaatcaataaataaatatagatggataactttaattcttttttttttttaatttgaaacttttatttttaaaaattaaaactcataaatataattatctaaaaaaactcatcaatataataaatgagtgaataaattaatgaatgcacaaaatcaaattcttattaatgacaccattgaaatttattatttttctcaatattaataatatatgtgtttttatacgcatttttttattaaatatcccattaattatcaactaaaaaggaatttattaagcacactaaataactaaaatgggatatttggttaaataaaagtgtaagtaatttttttttataaaaaaacaccaaacctctatgaaactaattgacactaaagtaatccttaagggggagagagactaaagaatagcattgttaggatgtaattatctttaatttttattcaccttttaatttttttcttatcgatccacctataaaaaattacaccttaaaatgaaaggaatcaactttttattttcgtttatagttttatgccgtcttacatgcatgcatggtacaacacgagcaacacatggactctctattttaatattttgtatattttaaaaatgcatggcttcatttacttgtcttctaatcaacaaaacactcacagtcacatgatccacttgcactagagatatttttgaagtctttttttaatgtataattcttaaccaggtcccaccttcaagaaacatgcgtttatagttttagaatggacaaggatatatgaacatccatgtatttaaacatttatttatcctaccaaattatatcatttacggtatcaatgttttttgtccgatctttatttatttctcttttaaagtgctcaatagaatagtgtccacgttgctttattcttttagaaaaatatacattaacacctgaagtgctagttgtcgcttagggagagaaaaataaattaaaaaatagcaattataattgaacatttatttgttataaatatatgatcaatatttttatttttttctatctactcttaacacatcataaattcttaatacttatatttttttcactagaaattctaaatacttattttttttttcactaaatgtctaataacatttgggatgttcattatttaaaaaaaaaatagaacaatgataaacactaaccattttttatttcaagcattcacaaatacttctcatttttctttatcttttttttccatatgtcatacctacattattttttgagtgaatatttcaactcccacttattttaaacatctcatcaataatttttatttctctccatttctatctttttatcacatcctaaactttatcatatttatattatttcatcttctgttttctttctctagatgttggataacacattggaaaaatataaatataatagataatttgtataataaagaaataagatgtgttaattgaatatttcaaatacgcctgcaaagatttgtcatatgccaaagcacatgggtttgatattggttgtagatataagaattttattagtgaataagatgtaaatatatgagtaaatattctttcaactttgagattaccataatcctaataagtctccatattaataggtgtaatattatcattaatttataatttttttcgtgacagaacagagacatgtgagtatcgtcagagtatatatataaaccccgtgataagtccctgaccttagcaatctatagcagcacttgaaaacacaattcatttccttgtttccttcccaatcaacacatagaaccagagtgcaaagcttttgcagtcagcaagagaaccaaaaaaaatcccacaccatggatttgctcctagaactgaaaaccgcactggaaccgttccgcgaaacactattgttcacaatcccattgactctattgctgctgggcatagtgtcccgaatccgcagaaaaacggcgccgtatccaccgggcccaaaaggcctccccctaataggcaacatgaacatcatgaaccagctcacacacaaaggcctggccaacttagcgaagcaatacggcggcgttttgcacctccgcatagggttcctccacatggtggcgatctccaacgcagaagcggcgcgtgaggttctccaagtccaagacaacatcttctccaaccgccccgcgacaatcgccatcagctatttaacctacgaccgcgccgacatggctttcgcgcactacggtcccttctggcgccagatgcgcaagatctgcgtcatgaagctcttcagccgcaagcgcgccgagtcatggaacaccgtcagagacgaagtcgacttcatcatccgttctgttacgaacaacctcggaagccccgtcaatgtcggagaactcgtcttcaacctaacgaagaacatcatctaccgcgccgcgttcgggtctagttcccaggaggggcaggacgagttcatttcgattcttcaggagttctcgaagctcttcggggcttttaatgttgcagatttcgttccgtttcttgggtgggttgatcctcaggggctcaacaagaggcttgtgaaggcacgtgcctcgctggatagcttcattgacaagatcatcgacgagcacgtgcagaagaggaggagtggccacgacggcgatgaggaaagtgacatggttgatgagttactgaatttttatagccatgaggcgaagctgaatgatgagtccgacgagttgctcaactccatcagcctcaccagggacaacatcaaagccatcatcatggtacgaacctccctgccacactatttattttcaaatgtctaatacatcaaagccatcatcatggtacgaacctccctgccacactatttattttcaaatgtctaatacatcaaagccatcatcatggtacgaacatccctgccacactatttattttcaaatgtctaatacatcaaaatattttattattttaaatttctcatcaccatcttttaaattagaagagaaaattattaaaaaaaaatgagacactgaatcacaaagaaacatcaagaagaaagtgtaagagaaaatatagctaacattcatatatattttaattatatatataaataaaatgaatacaaattgtacttttcttaaaaactattaaaataagatgactacaaattgtacttcacttagaaataagaaatttttgtatacttacggactgtctcgcgtgttcataattttaactttcaatttatcaggaaaaaaagatttcatcaaatatcacaaaaaattaacgggaatcattgataatactgtcctgtttggtatggagaagacaaataaaaattacagtattaatgaaagtaaagagggtgaataaaaatagagaagaaataaaattaaaatagattattttaattaaaattaaaattaaagagggtgaatacaaagatagctaaaaaaaatagctgaaaaataatataatgaattccatttcatcatttttaaaattattttatctcgtttttttttcttttatcaaacaaaaaaaaaatatcattctttcccccttctaatttgtctgcaaccgaataagcactgcatgtgacaataatgcaagaatttttcttactccacaccattaaatcatcacttgtaggaaaaaaaataatcatcaatgaaagtactattcactatggctcaaccaccccctcatttcaattatcaacgagtctatgtaaagtcggaaaaaaaaaaattaaagactttcagacagtctgtacgtgcaaagatgtatcatcatcatgaataattataaattttcttacaatattttttttaacaaatcttcatggttattagatgaaaaaatattaaatatttttatttgtttataagagtttaatggttatatttaaaataattttatattattatttaatcataaattattattataacttttaaaataattattataaaaattaattaaatattatatatataataaattataattaaataatgatataaaattattttagctctaagtatccatccttctcagtctttcgaccgcctctaaaaaaaaagaaaaaaaacttgagttgccaggaactgtataaaaaaggtttgagacttgaaaagagcaagatatgtaagcagtggccattccggttgctattttctctgtttataatatattaaatatatgtattctttcatttattttttttataaagtattaaagatattggtaagaaaataattaatgtgcgggaatataactttacccagtatacatgtcaaatagtaattcactcaaataatatattcttagctaataaactcttgtgccatgatattttcgtctattatttgttttgtgaaaaagttgaggctaggaccgcatattttcgtctctaagtcaaatggagtaatatgtgattatagattgatgtggatggtattacattacaagaaaacataaaaataaaaaataaaaaaatacgccgacaaaacaatttccaaaacttgtttctttgtttagaagaaaacaaagaccattagaattgtatgaaaattatttttgacttgctgtataaggagagattctttaaagattctctccaactggttcgtttgtttaacataacctggattcgtttgtttcataaaaaggatgagatttatgggtaataaaaagggaagaagggggaagagaacaattcttccttcctttggacatggaaaaggaaagtgtgcgaggttagtcctacgtcacttgtatcatttctcagtttatgaatggaaattcagaaacaaaaaacgggttatattacttatattttattttctattttttctttcatttttctaaaaaaagcaacttttaacctttttgtgaattaatgtgtagaaatactattatgcatgttttattatttcatatttcagtaatattttagtactaaatgttataataggatgaagcacattaaattaaaggattgatactatttggtttgtaaaaaatagggtgggtttaggaaagaaggaagtggggggaggtggacgtactatcaaatccttccttccttttttgaacatcgttgactgtgtaataattgtattttttttataactggaaataattatatttgcagctaagtcccacatcattcatataatttgtcaatttatgaacggtagaaaaaaagggctacctgacaaaaatattttaatttatattacatttattttatatttgagatacttatgctattttatattcatgttttgtttcttcactttctatacaactaaacaagtaaaaggaaattgtttatctctctttcatttcactttttcttctgtcgaataatctaaaaattattatactttctacattttttcattctttcacttttttttttcttatatcaaacacaacaaaaatgttaaaacaatattttactttatatacttttatatactttattacttttatcatatacttcagtaataatatgatggattgtcttaagaagaaagtaataatatgatgtgacacatcaaaataaaagattgaaatgtttatagtatccctagtcacatgtatgtgacaaatagcttgtttattatttgtttaaattaatagaaaatgatatttttaatatagttcggatattctggtaatcataacatatattcctgagtaataaaaaatgtgaaccaaacgtgtgcttcaattattcctagacccagtgtccatgcataattttttttaaaaaagattttcatgttacaggcaaaagcatacactataattaactagttaactacgtataaaatatgcaaacttagatcgggagaatgaatggtataaactgtgaagcctcaaagataaaaagtccccattgttttaatttagtggttaatatcggtgccaattatctttcggtccatgtcattgtgatatttcaatttcaagttttgaacaacaacaacaaaataatacaaacaaaaagaaaagaaaaccagaaatgaaactgttgatgtaattattatttttggtttttgtgtacactagtaaccagtaacactattaatgtatagtatttgaaacaagattttggtggatagtaactgacaactatgcaagaccatgcaggacgtgatgtttggaggaaccgaaactgttgcgtcgggaattgagtgggcaatggcggagctaatgagaagcccagacgacctacggcgcgtgcagcaagaactcgccgacgtggtgggcttggaccggcgcgtggaggaatcagacctcgaaaagctcgtatatctaaaatgcgctgtcaaggagacgctgcggctgcacccacctatcccgctgctcctccatgagactgcggaggatgcggcggtgtgtggttaccacgtgccgaagggctcgcgcgtgatgataaacgcgtgggccatagggcgggacaagagcgcgtgggaggacgcggaagcgttcaagccttcgcggtttctgaacccgcacgtgccggatttcaaagggagtaactttgagttcattccattcgggtcgggtcggagatcctgccccggaatgcaactgggtctttacacgctggaactggccatggcacacttgcttcactgcttcacatgggagttaccagatggaatgaaacccagcgagttggacacgagtgacgtgttcggactcaccgcgcccagggcgagtcgactcgtcgcagtcccatttaagcgcgtgttatgccctctctaataaaagaaaaaaaagtatcgcaagtttacgaataacggcctcgaagggcttcaccaaagtataaaaagaacatggcggtgaagtgcttcgggactttaaggttgttttttcttcttctttaattgatgttttttattcctcaattgtacgtgggtgatcgtgtctggaggagaacccagttattgtaaagaagacaaggggatattaggttaagttttctgttgattattgtaaagacgatttgatctacgtgcggaaacatcattattgttgggttcacttggttgtattttttggtcgcactctggttttagttgtttgcaaacttgataaaaccgcagcaaaacggaagtaccttgcaaaagtcttgtccagaaaatttagggttttattaggcaaaatttacatggaggctaaatataaattattaaattcagggggcaaaattattgacaaagttttataatgtagtaattttaacatttcacttttaacaaataatatatatatgactaatttatttaagttattttacaatataattgattccaaataaaatttgagtaattttaattttataaattaaaatatgattaataatattattttagtgatgcttgattacactttcaaaaaaaaaagtaatgcatgcattaacaaatataatcttttcattatacttttttgaaaaattattgtttaattattcaaatcaacaatattttttaaactttaatgtattaaaaatatttttgcaaaaattataccttcttagtcttgtcacgggcgtctaattgtcatgtcattaccttcaatgacttgcatggacgtgtcaatgattgaacatgatgatgtaacactctgtttgtcatatcatcacttaatgaaaagatgactaacggtaggtagtaaaataaaataattttttttaagtatgtatttgataaaaaaaaataaatttttagatagtaatctaaaaacaacctatttttcaggtatgaaaaacttatttaatatatgacatgaaaaatttatttaaattatatataagtggtattttaccgtttataattaatgtacatatgtaacatattatgcattctctcactattccttcactattctctggattcaaaatgtatatcctcattatttgatcttgttggattctcttctaaccttgtccagatattaaaatgtatgcatcttaactctttaattttacctttaatattatcttattaatctagttcaattaattaaatacgataaattgatatatgagttattgtaaatttcaaatagtattttttttaaatgtatttcttattttaaatgaggaattatcttaaaaaaattaaataagataaagtttctcaaatttatataaaattaaattacttatatgtttatcaagttattttaattaatttttaattttttgacaagtttacaaatatttgatcaaataaaagtctatgagaatcgattttttttattgacttataagatttgcttttaaacataacttaaatttactattatcatttttattttcattttcaataaaatgataaaatttatcatttatcattttatctgaaattaaattatttattttgataaaactcctccttatcatttgttaactaaaaaattatttttcatattgacataaataagtttttcatatctaaaaaatagaccaattttagattattacctaaaaatttattttttgtcaaatatttacctgaaaaaaaaatagtttcattttactacttgttgttaatttcttttcgttaagtaatgacgtgtgacagagggagtgccagattatcatgctcaatcactaacacaaggtaataacatgataatgaagtatttgtgataagatgtaatgatatgatactccatctgtcacgtcatcatttaacggaaggggaaattattgtcaagtgcttggttgaaaaaaaataatgttaaatgatatttaaaaaaacctatattccatgtatgaaaaaattatttaaataagttattttgtaatattcgttgtattgtatcaaaagatatttcatacatttgttaactttttattaatgctttttttcaaaattttataacaaagttttataatttatatatattcttttacaatgaccttctatttagatatattaacaaattaagttttatctgaaaaaaaaaattaattaagttttataatttagtctactttttccatttttatccgctccatttctcacattttattctctcttatct

SEQ ID NO: 106 - DNA, 7224 bp, Glycine max; identical to SEQ ID NO: 104
  source 1..7224: /organism="Glycine max" /mol_type="unassigned DNA"

SEQ ID NO: 107 - DNA, 6752 bp, Cynara cardunculus var. scolymus
  source 1..6752: /organism="Cynara cardunculus var. scolymus" /mol_type="unassigned DNA"
tgttgtgttatgtattgttttaattgtaaggaatataggacaaaaattagtcttctcttcttcaatacaatcatttttatgttatataatatttttggaataacttcaaaattacataacgagttatctcattttaaatgattaagtccttgaactatttttttaaatgaaaaacaccattaatttttttttaatgaaaaaccattaaactttttcatttttattaattaaatccctggacatttaaaaaaataaatcatgcatttttaaaacttggttatctacatcattttaactcaaaaaaattacattactcaactagcaatagttcgatggtttgtttatttaaaaaatcaggtttaatcattcaaaatgagaaagtttaatggtttttttaattaaaaaaatagttccgaaacttaatcattcaaaatgagaaatgtttaatggttttcttcattcaaaaatatagtttaaagactcaatcatttaaaatgagaaagtttgttgagtttttttggacttttctctaatttttctatataaatcaatatatttgtcatttgtgtatgtatttgtaggacattaaatatgattaagtatatgtatattaattacatggaataatttaataaaaagtaacaaaaaaaatacaattgttagtattataaatatatatatatatatatatatatatgttattttccaatatttatttattttttaaatatgttattaaaatttatataaataattaaaaaatctaattaagaagaggttgaaaaaaacgtgaatatagatgcttgaaaatggtttggaaaagtagtctggtgtggcaagactgcaaaacgttttagcacaaattattataatatttttattggagttggttattatacaacttttgatatttgtgtaaccaatataacataatttcaattgtccatttcatttgattaatatgtgatttcataaaaaatttgattgttttctaatataaagtattgatcataattaatgaaccatattcatcttctataaatattcaaatcataataaatgaactcttatcatttccataaatatctcaatttattgggttgtattgattgtataaatacgacgggttgtatttgaaacaaactctatttttatttttaataaagctttgttatgatattatactcacaaaaatatacaagtcattattaaattaaaatgatttgagaataactaataaaattaagtcattattcttttatattatatttcatataattttattaattatttaaaatatattatctaaattatacaatattgttgatataacacattaatggaaattaatttttaaattggtttataaattacagatatatcataaataattacactgatagatgtaggaatgatcttacatgattaacctgctaatataagatgattttggtatattataccattttagattgttatttattcatttaaccagctatctatatcatatttttcagtatttgaatactactgtattttttaaccagattttatataagattggttagaattacctataattaaccttttactcgaaaatattttgaaatctctttatcatgtttccttttaaacaataagagtagaattatgacattattttaattatatttgattttttcctattttttaattgacatatacataaaatatatatgtatatatatatatatatatttatcatatatgtgataagaaaattagcttttttatttttaaaatattatgaaaaaatgaaaattaaagtcaaacaatttgggaattaatttagaaaaatataaataattggaaactggaactcattcaaacaggaaccacccaccttaccctgtatatatacatccccttatttctttcattaacgggcaaccttctctcagttgcacttcgtagtattacacacatacatattccgatacgacggttcttcgccggaaaatatggatgttttacaactccaagggctattacaccctatgcccatcctattttacgttgcactccctctcttaactttcttccttctttccagttttcgccggaaacctcttccgccgggtccaagggggtggccgctgatcgggaacatgttgatgatggatcaactaacccatcgtggtcttgctagtttggctgacaaatacggcggtctgcttcatctcaagatgggcttcagccatacagtcgctgtctcgtcaccggaaatggcgagacaagtactccaggtgcaagataacgtctttgccaaccgtccggccaccatcgccatcacttacctcacctacgaccgggaagacatggcgttcgccaactacggtcccttctggcgccagatgcgtaagctttgtgtcatgaagctattcagccggaaacgagcggaatcatgggattccgttcgggatgaagttgtctccatgatcaaaatcacggcggctagttccggctccgccgttaaccttggtgagctcgtgttcgggctgacccatgacatcatctaccgagccgctttcgggtcgatttcccatgaaggaaaagaagagttcatcagaattcttcaagaatacaccaagctttttggtgctttcaacttggccgatttcattccatggctagggtttatcgaccccgccggactgaacacccgattaccaaaggcccggggtgagttagacgggttcatcgataaaattatcgacgagcacctccggaaagagaagaaaaccggcgacgacgccgacaacgatatggtggacgagatgttggcgttttacagtgaagaaggaaaggtgaacgaaggcgaggatttgcagaacgcgattaggctcacgcgaaacaatatcaaagccattattatggtgagttattttttaatattttatttttgttaaaataccaaaaataacaaagtttatgatcataaacatatttattaattaattaattaattaaatcataaccgtgatgtttgattggtttgagtttggctccaaatatcaaaggtattaggaggtccaaggttcaaatccaagaaggaataaaaattctcttatggtcacggaggttcaaatacggtgactccgggttatctgtaaagtaggtggtcgtcctaggactagtcagctcgcatagtgggttgtatatcctggttaataaaaaaaatattatatatatatattttgcttgaaatataatctaatgaatataaatatgtgttaatccacaaattaagtaacgtttccccttataaaagacctttgatttagagtcaatttggtaacatgtataacaattaaatgaaatcataaattctatttatttataaaaaaattaaatatttaatacatattttatataaaaaaaatatttaatgcaatttatttctttagaagccgtaaagttaagtgaccccatttcattaaactttttcttcattttaataattaatgattttaatttattttaaaataatcatcaaaaaacaaaatttatataacaaccgatgtcatcttcttaattttgttttcacttataaaacaaatatttaatggtgaagatcatgaatgattccatctccatgctcttgttaaccccaattaattgtcttttttttgggtttttttaatctaattaattaattttgtgcttattttatccttcaattagtatattattttgaataaaaacagattgtattagttgaaatgggcaaacatccacaatcttgatcaagtcatcaaaatgggatatcgatagaattatatatatatatatatatatatagatttgggatcatatgagaaaagcatgttttcatgagactcgtgacaccaactttttacatttgaaacttcatcgtgttttttgttgtgaaggttcaacttttttaaaccttcacagtgtttttgctgtgcagtttcacgtgtaaaaatatggtttcacgggtctaacgaaaacagtctggtctgacgtgaacccaaccatatatatatatatatatatatatgaaaagatgacattagttttgcttaataaagaattaacatttggtaaattatggctttcttataggatgtgatgtttggtgggactgaaaccgtggcttcggcgatcgaatgggctttgacggagctcatgcatacaccagaagcactcaaacgtgcacaacaggagctcgccgatgtcgttggccttgaccgccgtgtcgaagagtctgatttcgagaaactgacctacttcaaatgcatcatcaaagaaaccctccgcctccaccctcccatcccggtcctcctccaccagtcatcggaggccacagaagtcgccggctaccacatcccaaagggaacacgagtcatggttaacgcatacgccatcaaccgtgacaagaacgcttggaaagaccccaacacattcaacccatctcgattcttggaaaatggagctccggatttcaaaggaagcaactacgagtttcttccgtttgggtctggccggagatcttgccctgggatgcagcttgggttgtatgcgatggagatggcggtggcccacctcctccattcgttcacatggcagttgccggacgggatgaagccgagcgagatcgatatgactgacgtgttcggactcacggcaccaaaggcgactcggctggtggcagtgccaactcctcgactgttatgcccactgtattaatcgacgaagggtcggatcttgacttccgagacactgaaaaattgttgatgttgcatgaacgaattcgaatggttttaaatttttttttcttttttgtggtcatgattttttttcgtaaagcaagatcgatatacaaaaagataaataaagatttcaatttcatgtacattaattcataaactcgatttcaattccatatattttcattcataaacgatatcgatagcttttgttttgaaaggtacgtagcggagccatccacattgtacggataaggcaagtaggtggtattcggagttaaaagtgcaaaggcctttctttcttgaaggggatgtttggttcggaaaatgaagatggtaggttgtatggtttaagacggatggatacgtaccaagttaaggaataaattatttgaaacaattttatcatgttaaataatttcatgacactaaaatgaacaatgaaattgatggtttttacggtttgtataaatgatatggtttgcaaaatatccctatcccccctatctctcaatctctctctctctatatatatatatagagagagagagagagagggggggggagtgatcaaatacaaaccatttaatttgtacaaaccgtgcaaagctcattcaaccaatcataattttttattttgttaatttttttttgtaaatttgagaggttgattaatcattttgataatacaattaaaatgagaatatggataaagaaagaaagaggttgttaaataattttattaaatacaaaataagattattaaattactaatttactgtttttattttattaaaaaataatattaattattggaagtgatttgctaatattaaatctcacgattatgacaagctatcgagttcttattttttgaatatatatatatatatagagagagagagagagtttactttgcgaaccacgttatttgtacaaatcgtacaaacttcattcaatcaatcataatttttcattttgttcattttttttgtaattatgagaggttgattaatcatttttattgttgagggtgttaatcatggatcttatcatcttcattattttaattttagagaaataatgaaacagtttcattaaaatttaattaagtattatatgaaacaatttcataaccatatataaaacgacttcatcaaaaaaaatattatatgaaacaatttcataataattttttataagattaaacaatgaaatcgacggaataaaatggtttgtatgatttgtataaattgggtagtttacatttgatcgttcatctctctatgaggggatgtatagtgtaacgtcaaaattaagaatttgatttatattgaaaacttgagaatcaatccatcgattagatgaaaagttatatttccaatgttttttatataggttgcaaggcatatatgtaatttcataattatggaaaaagttatatctcttttttttcccttaattgtttatgtaatttacacttgtattcatttacaaaattaaaaaactataattattttatttataaattattttcaagattatttaaataactttaatatatcaaaatatgtagtcaaaaatcaagatgagtgcatttgacaataaaatggtaatcaagacggaaaaaaagtgagacgttcaatctgttaagaagtaaggcatagttctaggagttataaaaaccagaagaaagatgttctggtgcattaaaaacatagtttgtaggtcacgaaaagttgcacgtagggtttgaactttgaagttgaaaaatggcttctggtgctgaaaagtagaagtttgttacattaattgagaaaaaaaagtttgttacattatatagaaactaaaccaaagttgttacattttgtcctaaaaagtaaaaaactaaagttagaagaaagttcggtttgttcaaagtctcattaacgtggttcagatctggcaaggtaagatcgaacgtagacttgtggtctggct

SEQ ID NO: 108 - DNA, 5847 bp, Cynara cardunculus var. scolymus
  source 1..5847: /organism="Cynara cardunculus var. scolymus" /mol_type="unassigned DNA"
atcttaactaaagttacttttcaggtcgatctgtatcaggataaaattaataaataatcgaagtttgataacttaacacgttgtttctaacacggaaactaacttctagaatttcatctgggcttccactacaacataacatgacaatcatatttcgaagagtcatataaaagatataatatacatcatttcgcttaacgtgtttttattgatacagtataatacgacatttagtaggacacctttttgtacaacatcttgtagaaatagttaattgaacacttatgaattgtttatgaaatgtttacttggtaagctcttaccggatcacttaccttattggataaacatgacaatgatcgacctagtaaaagggatggcaatgatcagtaggcttacccgataagtaagtttgttgactcttactcagtaagcgtttatcgggtaaaattattgcatatagtgtcgttttagtggcttagaatcttgcttggtaaggtaattgagagtgttgactcttatcagtaagtgcttaccaggtaaaacgtttgggtaaacaacctcttaatttgtaggatctgtagactggtgtcctataaaacagttattgggacactgatatgtattactaaatgtaatagtagttaatcatattttacaactacataaaaagtgtcctacgttatactctagctattaggaatttttagtgttacataaaacatgttattagacccttgaatttatttcataattatagaatttgttaggtcgtttagctttgtcttaacaacttattgtaacacatttagataagacatcaatgttttgatcctataaattaaaggatcctaaaaataggtttgtaaaacactactacacattctaataggtgtattttgttacaattgttcataatatttattccaatcttttagccacaactttttatttatttatgtaaaagtagtattttgaaaatatttgattaatagtcaaataataatgtaaaaagccttcaacgtgtagctcagtaggcatagagtcaggacgactttgtccaaatacatgataggtcatgggttctaactgcccttgttagtctcaaccattaagaaagacaaaaaatatccccttacatcggtgcgtatgtccgtgtgatactgattggtgttatcgataattactttttttgtccacataaaaccattttggggctaaaataatatggtgaacaaggatggaaacaacaaggacattccaacctttttggaggccctgctacatccaaaacttttgattacattgcataaataagatgacagatgatatatgtcaagaataaaaatgggttaaacttaaaacgattaacaagtatatttgggatccaaaatttcggaggccctaatcaaaatctcacatttaacatgttaagggacggccctggaaaacagtatggtacggggcggataaagcatccctcgaccagaccagacccgacctcgaaccagtcctcgactagactagacccgacctcgaacccgactaatctccgacgggtttggagggaaggaatccctagagggtttgggaacccattgggtacccctctaatatatatatatttttttaaattataattaattatcactgcatagtataaaggccgagtctttttatatcacatcggatgcatatacatagagatacaaccaccccaaattaagatgtaggccactctcttgatttgacgttcaatcttatatatcatataataataaataaataaataattaattaatgcatttcaagacaagcggatttagtcaatattttccattcattatttcagaaaaataagactaataataaatagtaaatcactgtacactttcaaacagggtgtgcccgatgaaacctgtatatatacacctcttcatttcactccttaggtagcaacaaccaaccagttgccacttatctctccacttgaatcaataatggattctatccaaatacccatatcaatctacgttatcattgccctcttaaccttttcttttctagcatggctacgccggaaaaacctcccgcccggccctatgggctggccggtcattggcaacatgttgatgatggatcagctcacccaccgtgggttagcccgtttggctgaaaaatacggtggcatcctccatctcaagatgggtttccgtcacaccattgccgtgtcctcgccggagatagctcgccaaattcttcaagtccaagataacatctttgctaaccgtcccgccactattgccatcacctacctcacctacgatcgtgttgatatggcgtttgccgactacggacctttctggcgtcagatgcgtaagctttgtgtgatgaaactgttcagccggaagcgggcggagtcgtgggattccgtgagggatgaggtggattccatggtgaccaccaccgccaccaactccggcttgccggtaaacttgggggagcttgtattcgggttgacccatgatattatttatcgtgcggctttcgggtcgacgtcgcatgaaggtaaagaggagtttattaggatcctacaggaatacaccaagctttttggtgcattcaacttggctgactttatcccatggctcggcttcattgacccggctgggttgaacacccgtttacctgcggctcgagctgcgttggatgggtttattgacaaaatcatcgaccaacacttggcaaaagagaaaaaggtcggcgatgaaaatgtggataacgatatggttgatgagatgttggcgttttacagcgaggaaggaaaaaccaacgaagccgaggatttgcagaacgccatcaagctgacccgagataacatcaaagccataatcatggtaaattctataaactcattttttaataattatgaatgataatttattaaatttattttctattttagtttattttaaataagtatatttacctttaattataaaatggaattactttattataattatcatttacttaattaaaaagtataataattacgtatttataaaattatatgatgatatatgttttgggaggaatgggtatttatttacatcatcttgtattctattaaaagtaaagaaaagcttttgattcatggtaaattattactaacacaaaaaattacatcattttgatgaaaattttgttgaattgtttgcaggacgtaatgtttggtggtacagagacggttgcttctgcgattgaatgggccatgacggagctcatgcatacacccgaagcgctcaagcttgtgcaacaagagttgaccaacgttgttggtcttgaccgtcgtgtcgaagagtccgacttcgagaaactgccctacttcaaatgtgtcatcaaggaaacccttcgtctgcaccctccgatccccgttctgctccaccaatcgtcagaagccacggaggtttccggctaccacatcccaaaagggacacgtgtcatggtcaactcctacgccatcaatcgtgacaagaacgcttggacagaccctaatacttttaatccatctcgttttctgcaaaacggagccccagattttcggggaagcaactacgagtttctcccatttgggtcgggccgaaggtcgtgcccaggaatgcaactcgggttgtacgcaatggaaatggcagtcgtgcaccttcttcattgtttcaactgggaactaccagatggaatgaaaccaagtgaaatcgacatgggcgacgtgttcgggctcacagccccaaaggcgatacgacttgtagccgtgccgactcctcgtctgttgtgtccgttgtattaaaactctggtttttataatattatttttataaaataatgtataagaaatatatataagaaccacaaagatttgattctataccacttgttcataggtcaaacctaatttgtgcatctgtttttttaattgtatttatgactttttaagcaaagaaatttcaaaaggttggcaaaatcatgctttcccaaattaaatatttgaaacaaaatctatgagggagacatagaaaaatgagcacaaacataattggaattatttatgtaatataaaactaaacacttttgaataaatttacaagtacaaagtttaaatacctagctacgtatataaattttaaataaagatacgagaaatcataatttacgttttaaaaaataattgatgtaatatacacgatgttaataatggaacgtgggtgaaatttaacgtgttgtattcttaaattagacgtacggatttttaagtacatgttttaaaaaaataaatttatatgataaaacgtgttttaaaagtgtaaatggaacgaaagtatggttattattgacgtaattagtcaaagttatatatttgtaataaattaatgatgattttcatatctattcaccacaatttttatatgctaattaaaaataacataatcgtttaccacaagaatacaagtttgggatcaatgttttcaaccacatgatgatgatgaggatgatgttgatgttgatgttgatgttgatgatgatgatgatagggatatttgaagtgaatgtttcacttgtgtaatgccattttccatgatgttgttgggatggtaatgtcatccatgatcatccatgtataatatataaaatgtcatttctttaacattataaatctagttttttttttctaaatttaattgaaatttaaaatttttaattcccgacttttctttgaaactaaagataagattgtaatgatatttaatttcaaattctattaaatctcacaaactagacgagttagggatcgtttacttaaatacttatcaagtaagaatttatcggtaaaattaacactatcatttacttaccggacaagattttattcactaaaacgcatcgtatgcaacaatttatcgcggtaagcgctaaccatggtaagagtctttgtcctcacttactggttaagactcgaaattcttcttttcgctcttaccgggtaatattcttagtctttgtcatattcattcgataaagtaaattgctttggtaagcgcttacccaagtaagcgttttgtaaacggcaccttagtgtttgtggatttatgacttaaatctcacaatcacgggcaatttctctcatgctacacacacttgtacataaattgatcgtgaaggcaagtttcagtgttttatgagttttgatgtcgagttgacaatgtgtatgtcatgataaacttccaattaattgttccttacattcgttgtgtaagatttaatatttttgagatgtttgataacgagtttagtcgtagtaaggcccatcaatacatcagtttggtcgatcacattgtatatgtgtcacaaagtaagaaagaaaactcaaatccgagtttcatatttctatctcggcacatctttcatgccaaataataaatgtaacttaggcctacaaagctatgtaaagaatgacaaaaaaaacgaataaaaacaagcctatttcagtttcgtaaatacaaatgttaccaccatttaatttattcaagtttttggaaaacaaaaaccgtacattgcatccaagataagcacattttcaataacttgtcatctcactacaacaaaattgggtttataggacgcccccaatctcgaagtgtcccaatagaccgttttatagaactaaaatataaagtgttctatctaaagacgttgtaataagtttatatgacgcttttggacgtcttaacaagtttttgaggacatttttaatacaaagtgtcacattagcaactttataggacactttga

SEQ ID NO: 109 - DNA, 6260 bp, Raphanus sativus
  source 1..6260: /organism="Raphanus sativus" /mol_type="unassigned DNA"
taagaacttggaacagacacaaacaaagacatgaagttggtaaggtcagactattaagagaatcaatatattattcgatttaatctatattattaaaattgaagtacaaattagattttttgaaacgaataacagtttttttttaaaaaaaaaattgtttagaaacatggataacaatttttaaaagtatgtttggaaacatgaatatcagtttgaaaaagtttgtttagaaacatggataagagtattaaaaataatataacgttgtttggaaacatggatagtaatatattaagaaaaaagtaacaaattttgtattattaaaaatactgaaagtctattatattatgataaattatctatttggaagagttttaaaatataagaaaatgagctaatataattaacaattttttttttgtctaaaataatcataaaacaagattaaaattttatatacatatttcaaatcaaaataataatttacacttgatttatatcaaaattgattcaaaaatatacatatattcaaaagcttattttactaaaatagtttccactaaccattataaaaaatattttcaatatatataagaaaaatacaataaaaagtccattaatttcattataccaacttaaattatggttttaatatttcacattaagtttttaaaatacaatatatgtgattatttatatgatggtatgtattaaatactattaattatatgattacttatatgatgatatatatgaaataaaattaattatatgatgacacaaatatgatatataatagtgattaggggttagcgttcggatacccattcgggttcggtttgaatttgtttggatttctggtttctgggatcaacgatttcagtctcatttggatatttctaaattttggttcagattcaattcagatctttgcagattcgtatttgattcaaatctttgcgggtttggttcggattcagataacccatttaaattatttttcaatttttagaatattttatactttaaatttctcaaaatatgtaaatgaaataatatattacatataagtttgaataatataccaaagaaactcatactaatagagcgttaacgattgtgagttacaccatccagttttgagttttgaccatcgtcgttaaagtgaagtggaaaaatagttttctcggatatttttgaaaattctccgattttagtggatcattagacgataatcaaatctctttcgaatatattcggataccaagatcattaaaaactcatgcttttaatatacagattttctattctaaacaccaaaaacgtaaagaatataatgtctccaagaatataacttcaagtttatatattaatatacttttaatatacatttaatagtacattttttattgtgtgcaaaataaccttgcatgtaacaataaaagtaagggaaccttgttagtctatcagtctatttctaatgtctaagctttagagctattaattgatattaataatttatctagaccttgtgctctgtggatatctttagtaatgttggaaagtagaaaaattacaattgttttacacacttgtataaatatagctgtcgaagtcgcggtaattcttataactaattgtttcaaattattatgttattgatggaaaagtatatttattcaacctatttattctaggtaaaaccaagcagtactcgttaatatttcaacagcattttttgtaactcaccttttctctaatttaaaatccactaataccaataatgatccattatatttctatatatgcaagaatatccattaaaaccagtcagtatattatttgtttccatattaaacaaaataatagtaataattaaaaaggaggtgtatgtataattgtatacatatatatgagtcacggaaatgaaaatccccgtagaaaattagaaatatgtcaagaaatgggaccactccttgattataaaacctacctttcgtaacacatcccaaaatggcgaactttgcctgatcaattcttgagaccctccacaaacaaaagaaaaagcatttcccaaaaagaaaaagagactaaatggagtcttctatatcacaaacactaggccaagtattagatcccaccacgggtattctcatagtcgtctcaattttcatcttcattggcctcatcacacggcgacgaaggcctccgtacccacccggtccacgtggttggcccatcataggcaatatgtcaatgatggaccaactcacccaccgtggtttagccaacctagctaaaaagtacggtggcttgtgccatctccgcatgggatttctccacatgtacgccgtttcatcaccagacgtggctaaacaagtccttcaagtccaagacagcgtcttctcaaaccgaccagcaactatagctataagctatttgacttatgaccgagccgacatggcgtttgcccactacggaccgttttggagacagatgaggaaagtttgtgtcatgaaggtgtttagccgtaaacgagccgagtcatgggcttctgttcgtgatgaggtggacaaaatgatccgctctgtttctaataacgttggtaagttcgctcgcgtatttacactcgctatctgcagttgaatatttaaaaatgaataatcatttttgttagtttattatgcatttgttttctttgatatatgtattttaatagtcaaccaaaaaaattgtaggcaagtctatcaacgttggggagcaaattttcgccctgacccgaaacataacttaccgggcagccttcgggtcagcttgcgaaaagggacaagacgagttcataaggatcttacaagagttctctaagctttttggagccttcaacgtagcggatttcataccttattttgggtggatcgatccacaaggaataaacaagcggctcgtgaaggcccgtaatgacctagacgggtttattgacgatatcatcgatgaacacatgaagaagaaagagaatcaaaacacagctgatgatggagaagttgttgataccgatatggttgatgatcttcttgctttttacagtgaagaggcgaaactagtgagcgaggcaacagaacttcagaactccattaaacttacccgtgacaatatcaaagcaatcatcatggtaaatatttttcccgaggcactagtaatagtcattattcttaatgcgtcgttacgtcataaaacttatccatttaactggctgtttttctcttaaagtatatattttctgtttctacaagtagtcaattgatagtagaaaaatacaaaggtttcatatcatacgtaaataaaataactgcaaatatcataacgtcatgtgaattgacttttttttttaaataggacgttatgtttggaggaacggaaacggtagcgtcagcgatagagtgggcattaactgagttattacggagccccgaggatctaaaacgagttcaacaagaactcgctgaagtagtcggacttgacagacatgtggaagaatcagacatcgagaagttgacttttctgaaatgcacactcaaagaaaccctaaggctccacccaccgatcccactcctcctccacgaaaccgcagaggacactgagatcgacggttacttcgttcccaagaaatctcgcgttatgatcaacgcgtttgcgattggacgcgacaagaactcttgggtcgaccccgaaacgtttagaccatctaggtttttggaaccgggcgtaccagatttcaaagggagtaacttcgagtttataccattcgggtcgggtcgtagatcatgcccgggtatgcaactcgggttatacgcacttgaactagccgtggcccatatattacattgcttcacgtggaaattacctgatggcatgaaaccaagcgagcttgatatgagcgacgtgtttggtctgacggctcctaaagccacgcgtctctacgctgtcccgagcacgcgccttatttgtgctgtttaaagtaatggttcgaagcacgtggacggtgaaaggaaaggtggttggtatggttcttggaagtggtgtgagaactcaaaagaagccctgaagatttgtggatgttatataatactatatgtttatgtatttgtgtactaatgaattaaagttatgtatcacgtgtgttctggatgaaacataaagtggctctttgtttcgtctttcattttcttttgggaaatattttccttgcatgaaatgtaaacactgaaaaataagatttttttacaactaatttgcatattacaaaaaagtatactaatgaattaatgatataaggatattgcatttgctggaaatgttaaaacataggcatttccatcactgtgagccacacatgagtttggcaaccggtgaactaagtgaatattcatcaattttaagatttgagaaacctaatgtagagaatatggagatgataacttgtaattttatcctaaattttcgttacattataatgataatgctagttgtcaattaattaattgttatataagaagagttttgttaaaagaacgagtttcacagtggaagttttattgtacatattttcttgttttatttgattttggtaacgcccgtcttctttattgaaaatatttatattttcctttatatcattagtatggaaaaatattgtagtctttatcgaaacgcatctattttacctgaactagaaaattctgaccattatgtcatagacccttcatttggacgctgttgggactaaactaatactctctccgtttcatattatttatcattctaagtttatgcacacaaattaagaaaatatttaattttgcatattttcaaaataaaagcattatcaccaatacatctaaccatatatcaactaataaaaaataaaatagagaatattttcaataaattttgcattgaaaaccgaaaacgaaacttatttttaaacgaaaattctaaaacgacaaataattccaaacggatggagtattatatttgttaattgaaaaaatcacttatacatgtatgtgttgattatctaggggttgactgtggaaacacaatttttgtgattaataacggttgtttccaaatcgtttcaaaccattcaaaatctcttaaaatcaaaggttagtttctgaattacggacagttatggttgaataaataaataaaaaaaatttaaattttttttttaaactttaacttaaattttaaaatgaagatattatgtataaaatatacataaacatttatttttagcttaaatcataaacagtatcataatttattttataaaaactttaaactaagaacattcactataatttttaaatattaatatatatacatataaaaggatatgttcatatataaacgaaacaaatattattttaaaagttttaataaaaatcttcaaaataaatttcattgaaattataacttttatttaaattaaaaaattaaattatcatgtattgttaataattatactatattaataattaatatattttatcatataagtgtgtttctgatatttttataatgttatatatgttaatattggtaatttattattaaatctatacgataaatcataaaaatcagttataaatatttagtgaacacgataattttcaaacattgtaccagtcatataaaattttatatgattagttacatttgaaatggtaactatctatattcacaaatttctgtatccacaaactcatacatccaaccacaatcgctgcatttgaatccgtaagatccttagtttaacaatatagatagatatcaaaatctaattcatgcatccaatcacaatcgctgcttttaaaccagtgagacctttaattttaacaatatagacgatcagatttctagatagatttctaggtagatgtcaaaattgtatctaaactactcacttgcaaaattgtaacaaccagaatgcatcaagcagtgatcgatcccaacttcaactactttgacgaaatcaataaattacaattacttagtctattttccgtagctacacgtagcgcgtccatgcgtggactattgcatatcacaaaataattgcatataatatcatcattatcagtatttaatgtccgagaaaaaaattcaacgatacagaaaatttctagtataaattataaacaaagtctctaaaaactagcggtgcctccttgacataaaacattttttcagtggtg

SEQ ID NO: 110 - DNA, 6354 bp, Raphanus sativus
  source 1..6354: /organism="Raphanus sativus" /mol_type="unassigned DNA"
tattgtttattaacatttgtatatttcttataacaataaatttaaaccgttaatcctaaaattttcaatgtgatatttttaatgcaaatttcaaaattaacatatttatttatttttatattgtacatagtttaatttaaactaatatgtatataatatgaatatatattaaatgagaattcatattgaactactttctttaaaacatattgaatgaaatcattacaccgtccaccttaaggcacaacaatatatcactgtattaactcaaatacataatttttgtgattcctcttatacgaaagggtcaaaatatgaaatcatgaatctttgcaccttgtaatatgaaatcaaacaaaaaaaacgtttcccaattaatatatatgggattagagtaatcatataaatcaatatattatctcttgtttatttacaattttttatggtaaatatatcagaataactattttatttgattgggtcagatgagaactatctcaatagtaagatcaccaacctaagagtattgcttccacagttgaatgattttgacattgatctcccacctaaacttgaatggtttcaagtctgaaacggggggaggggagtaaaagaggacaccgaacgtgttctaagaaatctatgtggaccactcacatgttttttttatgtgttgaccttctagcaaaccaaaacaaccttcttatatagtgatttgttcttatttttgtttacaaatcagaatgatcgtaagctttataccagcttcccataaataatactccacaatgactatatggaaaactgaatataaattagcaattttcgtgtatccgtaaaactcattataggaaagtaatgatctcgtgaatatattctctagttaatgtgttgctaacaatgcgcgatgtatattctttgattgactcttcaaaaattaagttaatgtgacagtgaacttggtggtatttatatagaagcgcattttaggaatgcttttaatttgcctttgactaactaaaacctgtatcattagcaagttagtgaaattaggcatatacaaaataatgatacatacaaaaccgttcaaaattccatctacaattctacatataaagaaaaattcagaatgtaccttcaggtgagcatggcaatacagaattattataccctacatagaaaaagaaaaaccacattaaatatatttaaagattagttttacgaaactatcagtaaaatatcaaaacatgatcataaagatacaaatgtatattttaactctatagtcctcactcctcaatgactatatggaagaaaaaaggaaaaaaaatagaggcttctctatagaaaatttaatggttatgttcaaatgtattatcgatagagaaagaataaaatttaaaactatataataaacctcttgtatcaaaatactatgatccaactcaataaaccacaatgactcaaacatcagcaaagaaataaagtttggtttttctataaaaataataatggttacatagaaatacatcgtcgagtgaaaattcatggtcaaaattaatttgtttatagatacaaaaccataaaatagaccctataatatatttcgaaagtacaaccggactcaataatccactatgtctaaaaatccttatagtaaactatgtaataatatgtttccgaaaatggttggaatctttagacacaagtaataaatatatttatgactaaacgttctaacacataacgttacgtatcatagtgggttacattgagttatccaaaggacaattgaataatatatattcaatggcataatatcgtaaatactctagtaatttatgtctacttctataaaagggctgagaatgcttgtgaagatgccacatcagtaatggcatttttgttaatcatacatcaagcaaaggttaattattaaaagtgctcctcaaataataagaaagggatcacacttagaaatatgtcaataaatgggaccacactttgattataaaacccacctctctaatcacatcccaaaatggcgaactttgcctagacctcttacaaagaaaaaagaaaagaaaaatcagtatggagtcttctgtatcacaaacactaagtcaagtattcgatcccacgacgactattctcatcgtcgtctccgttttcatattcatcgacctcatcacacgacggcgaaggtcttacccacccggtccacgtggatggcccatcataggcaatatgttaatgatggatcaactcacccaccgtggtttagcaaacttagctaagaaatacggcggcttgtgccatctccgcatgggcttccttcatatgtatgccgtctcatcacctgatgtagctcgacaagtcctccaagtccaagacagcatcttctcgaaccggccggcaacgatagctattagttatttgacttatgaccgagccgacatggcgttcgctcactacggaccgttttggagacagatgaggaaagtgtgtgtcatgaaggtgtttagccgtaaacgtgccgagtcatgggcttctgttcgagatgaagtggacaaaatgatccggtcggtatctagtaacgttggtaagttagttatatgcggctaaatatgtaaaaactaaaaacaacaaacatttttctctcttttatacgtattttaacaggcaagccaaaataaattgtaggtaagtcaataaacgtcggggagcaaattttcgccctgacccgaaacataacttaccgagcagcgttcgggtcagcttgtgaaaagggacaagacgagttcataagaatcttacaagagttctctaagctttttggagccttcaacgtagcggatttcataccatattttgggtggatcgatccacaagggataaacaagcggctcgtgaaggcccgtaatgatctagacggatttattgacgatatcatcgatgaacatatgaagaagaaagagaatcaaaacactgttgatgatggagatgttgataccgacatggttgatgatcttcttgctttttacagcgaagaggccaaattagtgagcgagacaacggatctccagaattctatcaaacttacccgtgacaatatcaaagcaatcatcatggtattttttttttcaaaagaccactaggcatagtcattattattagtgcgtcacaccacagaagtgatatccatctcaaaccactagtttcatatttttgtctaaatcaggaaggtagctttctgtatttacaagtagtccatatgaattagagatcttgagtaagcattaggggaaatgacgtcatttactgatagtaagaactctagaatattaaatttcagaaaagacctaaaatacaaaacatgcaaaaaatatgtacaaaggtaatataaatcacacgtaaatataaactgaccgtctttgagctaacaatttatttattttaacactttaaaacttaatttgaaatttgatataaaataaacctaatttgaattgattttttgaatttaataggacgttatgttcggcggaacggaaacggtagcgtcggcaatagagtgggccttaacggagttattacggagccccgaggatctaaaacgggtccaacaagaactcgccgaagttgtcggacttgaccggcatgtggaagaatcagacatcgagaagttgacttttctgaagtgcacactcaaagaaaccctaaggctacacccacctatcccactcctcctccacgaaaccgccgaggacactgagatcgacggttacttcgttcccaagaagtcacgcgttatgatcaacgcgtttgcgattggacgtgaccctaagtcttggcctgacgccgaaacgtttagaccgtcgaggtttttagaaccgggagtagcggattttaaaggaagtaacttcgagtttataccattcgggtcgggtcgtagatcgtgcccgggtatgcaactcgggttatacgcgcttgagttagccgttgctcatatattacattgcttcacatggaaattacctgatgggatgaaaccgagcgagcttgacatgaacgacgtgtttggcctcacggctcctagagccactcgtcttttcgccgtgcctagcacacgcctgatttgtgctgtttaagttatggttcgtagcacgtggcgggtgtaacccaacgaaaggtttgtatgggtgtgagaagtcaaatgtagcactgaacatttgtggatgttattatatgtgtgaatgtgtatcacgtgtcgtctggatgaaaacattaatgctctttttcgattttccttttcttttgttgggatttttccttgaatgaaatgtaactggtaaaataaagtttttttttctacaattacctttgcatattacgtaggtaaacaaactattaagagtgcatttgtcagaaattttatagcctaggctcagatttccatcactatgagtctatgacttacaagagtttggcaacatgtaaaaccaagtcgcttttcaaaaaaaaaaaaacatgtaaaaccaagttaaaagctcaattttagatatgaagaagctgctatatagcctttagtcaaaaaaaaaaaaaaaaagaagctgctatatagggcaagttggaaatcataacttgaattttaaattttagttattgtttgtcacttctcagtttatatgcatgttaaaaagccaaatcaccttagttattaaacgaactagtcacttgtaaaatattttatatattatcactacacctaccttgacgaaagcaataaattacaaatcacttaaatacgttagatttgtagtcgatatacacacgtagcacattcatatacatacatacgtacgtatgtatcatacgtggactatcgaatatcacaaaataattgcgtatatcggtatatgtattattctcagtattgaatatgtcacaagcaaaatatataaccaatacagaaaatttagaaaagataattattgccagtaactaacaaacaagcggtgcctccttgacatacattttgtgtgtgtgttggaagcttacgaaaacgacgattttacagacaagcaatgtgttgggaagaattgaatagataccgtaaaagtagctctaagccaaactattgttgaagcttaactatctaagtgacatatttgcaaacagtggcggagccaatgtattggtaaatggatcaattgacccatgtgaatttcttattttaatttcgtttacttgtataattctttaaaatcaagattattattgcaaattttagctaaataatctctatgatctatgttaacttcagagttgactcgcctaaaaagttttcttagctcctccactatcttcaaagaggttggttcgagtagggcttgtctttgtcttctagagaagccagcttctcgacccatcaaccattcaagtcatactgtttcatttttttagagaagccagcttctccttgaccttgcgcttaaattttggcctttatttttttcataaatagttttacttctgattgtagggacaattcagtcaggcgaccccatttcctttcattggtatggatactttaaaaaaatgcagtgatgaggggattggaatagatctatataacagttgaggttgagcaatgcatgcatggttataattgtaatagaagaacataacttgacaccctcgtaaatgagacagaagcgctgtttaaaaacattgttactactaacttatggagttatttttagttattttaacatggtaacacgattaaaagagaaattaatcggacctcaaagaaaaaagtcttctttcagacataaatacaaacatcagaatccacattttcatttttccttttcgactttttttttgtaatttaaccttttctactttttgagtagaaaaggacacgagaatagtagctatgaaagaccagcatggtcagagaaaacggtaatatgtggtggtggactccgcacgacggcgtttcaaaacaataacaacgcataagttgtcgtctttcaccggcgtcgaacgttcagacaaagacgatgacaattaacaaacaaacaaaataaaagaaacccttaatgtctacgtacagttaataacgacgcttttttttgttgtcgtctgtaattcagaacatgtgaacaggataaaaataaatgcgaagacagaaggtcctattatttgtatcatatacgaatctgttaggatctcacatctttgagtttataaatggaatataaacaatatgaagagagatctaatgattgtcaaattttgagtctgaattgcttacataaaatcaccatacctacgtttgtcgat

SEQ ID NO: 111 - DNA, 6051 bp, Raphanus sativus
  source 1..6051: /organism="Raphanus sativus" /mol_type="unassigned DNA"
cagattcaccatggccaaagaacaaatgaaacattaagaaagaactcagatttttggcatctaagaacacaaagagagtcaagaacaaagatgaaactttgtccatcacaatttacacagatacaaattagggcatataaaaatatgtttagatcgaaataaacgaggagagagaatttggtacctctcgagtaactcgcggaaggagtagagagaagagaagggtcgggtcttttccaccgtctgctcgttctcagatctattaaaaaaacaaacatatcaatataaataggaagaagaggaggaagacgaaggtcacgaagccaaagaggaggaagacgaagagatgtcgacccgtggtgatggtgaggaggtgaaaccggtgaggagatggagaaatgagttgattgttacggagaaagagatagattggaagaagaacattggaagaagaacaatccaacgaaggagagagggaaaaagaacaagaaaagaagaaagaaacaaaaaaaaacaaaaagagatttaatctggacccttcataattttaatctaatggttaatattgtcaatccacgcagctcattcttattggttaagaacagagaggtttggagaaaataaaaatacagaaataaaaaaatctgtgttttatttatgttgtttagctattattaatgtctatattttttttaaaaaaatagtttatctttttaaaacagtgtatgattcttcatatactttgatcatttattttataagaaaatggttagatttaaatgtaagagtttatggttttgtatgtaagtttaagtttggggtttagggtttgaagtatgatataggatttgagtttatatgatatatggtttgagataaaaatttgaaatgttctatatagcttgaaatgttgtatatagtgagaaatatatttatcttataggaattgattttatttaaaatataagatttcatgttttatgaaatagattaattttgaagtatgtggtttatagttaagatatgtaattaagtatatgatttgatttttttaaaaatattgagtttatagttttatatttaagattttgaattcatataagtttgaaaatattaagtttgtagagtgattgttataatatatgtttgtaagtttatggtttaatgtgtttaaagtgatgaaggttatatatatatatgtggtatgaggttaattttttaaaatctgaaagttgtaaataagtgttggatattagataaagttaaactaggtaaatattaattagatatattgttttgtaaatatatttaagtttaggatatatatttggggtttagggtataaatcgacatagccatggaaaaatagtggctatacagtggctaacgctcttaccacagaaataaatgtggctaaatcgtggctatgatttaacataaaaaaaattatttactttcgaaaatgctttaaccgggaaaatgtaaaaaatgtaagcgggaataaaaaatccagtggctatatatctagccactataatatttggtggcaatacagtggctttttatctagccacgataaaattcagtggctactatcgtggctaattgactttaccgtggctaactgaaaatcgtacctattttgtggcggaatcgtggcttttttaatttagccacgtttttggagtggcactaccgaggctatgcggaagatttctactagtgataatcacaaaatgttcacacgaaatgacaacaaaacaatatatccatacatatactagggcagtattatttttgtatatatgatctaccacaaagttgttcattttgcaaaagtcaactcattgttttatataaaagtccactctttgaaagtttttattttgtttagatgataaaaatatactcatcaatggggccaagttatggttataaaatctagcgctggccttaataatcacatcatctcagattagttgacacttgacagactaataatggagtctctattatcacaaaatctaaaccatgtaatagatcccataccgtcagctcttctcatcaccatctctcttctagttgtagtctacctcatctcacaatggcttaaaccgctctaccctcccggtcccaaaggcttaccggtaattggaaatatgctaatggtgaaccaactcacacaccatggtctagccaagctagccaatcgatacggcggcttgttccatttacgaatgggatttcgtcacgtgtttgccatcacatcacctgacgtggcccgacaagtcctccaagtacaagacatcagcttctcaaaccggcccgtgactgtagccataaactacttaacctacgatctagccgacatggccttcgctccttacggacccttttggagacagatgaggaaagtgtgcgtcatgaaggtgtttagccggaaacgggccgagtcatgggcatcggtccgtgaagaagtaaacaatatggtccggtctttgtctagcaacgacgtcggtaagcccgtaaacgttggagacctcattttcacattgacacggaacataacgtaccgagcggcgtttggtgcggcctgtgagacagaacaagacgagttcataaggatcttgcaagagttctctaagctatttggagcatttaacatcgcggatttcataccgttcctaggctggttggatcttcaagggataaacaagaggcttgttaaggcacgtaatgatcttgacgggttcatcgatgaagttatcgatgagcatatgaagaagagggagactataaacggtgatgaagatacagatatggtggatgatctacttgccttttatagcgaggattcatcacctaatcgtagcaaaaacgccgtaaaactcacgcgtgataatatcaaagccctcgtcatggtaagccaaaacgttaaccttttttatctatatgattttcctcttagtaatcatttattccgttaacatttctataaataaacaactagataatttagttgtaacgatatttcagccaaattttaaatttgaaaaccaatttcgaccaatttaattactaaaagaatttttgaagttgatggtttatatattgggatgaatgatagtttcgaataatattaattagtagcaattatgtattaccgttcttgtttgtgtatacaataccattttggttttggaagtgatatttatctttgtgttacactgttaggaatcatacatttgatatgagatggaatataaagtagtacacaatagatattgttatatttcagttgattatgaatttgaaattcataaattttttggacggttttgataactaaaataaatggtagctcgatatatattaatttactttttttttaacttttattaatttactttcttattactggaaggatgttatgtttggaggaacggagacgatggcgtcagggatcgaatgggctttgacagagctactacgtaacccagctgaactcaaacggctccaacaagaactcaccgaggtcgtgggtcttgaccagcgcgtggatgatactcacctggagaaactaacgttcctaaaatgcacactcaaagaaaccatgagactccacccacccatcccactcatcctccacgaggctatcgaggacacaaagctccaaggcttctctgttcccaaaggctcacgcttgatgataaacgccttcgccatcgcgcgtgacccgaagttgtgggttgacccggaaacgtttcggccttgtaggtttatggaaccgggtatgcctgatttcatggggactaacttcgagtttataccgttcggggcgggtcggagatcgtgtccgggaatgcagcttgggctttatgcgatggaggtggctgtggctaacatcattcactgtttcacgtggaagttgcctgatgggatgaaacctagtgagctcgatatgagcgacgtcatgggtcttaccgccccgagagcaacgcgcttgatcgcagtgcctgacacgcgcctcatatgctctgtttggccctgaccatggagagagaggccttgttgttctgttcaggattaatggtgcaaaagctttcgtcttcttttttaaaatttaaactatgtttttctttttcacttcgtttttctgttcccaagggacttttcttcctcaaaatgtatatgtaaataaatgttgtacaggaagaccaacgtacaaaacgtaaacaatgttgtgtgcagccaaaaaaaatatcacgaagaaacatttgatcatatcttcttcttatgcgccgctcttttctttctttctgatgatcagacaatctctggacactggatgatgtatggtataatgtgtgcccgccctggttatgattctctccggttgaaccgtgcccacagctaattgttagttcttgaaagcatttgtggagctcatagagtcacctttgcttacatcaagtaaaaggctatgcccttcaacgggactgaagctaacgttaatggagtggtggattgataattctcgagggccacggaatgttgaagttggagaaggaagacgtttttggcactccatggcttcgacttccgccaaaagatctgagactgactcgtcacattcgtcaggtccagtcacaatgggttgccaatccgtggtatcattagaggcaaagttgagtttgaaggttggactaaagacatctaggaagtctatttcttggttgtctgtaaacgacaccaaaccagaggtgttcgaatcccacacatttccacttctgttgcaggctgagctctttgtgatgatactgttactgctagttataacactctggtcagtacacactgagttggagctaaagtcaagtactctactctctagtttagtaacagccacgctcctgttttgatcgttagctatagtaattgtctcttcctgcttcaagtcatcgattggtgtattattggagagagcagcagactttacaacgtcatggtttctgctatcggaactggaaggtctaaactaaaacaaaattttttttgtcaaaaacgttatatgcatgggtatattatagatatatgaattatttttattgtcaaaaataaaacaaaaaaattggtaaatggtaatcctatctaattcttgagaccacatccttcaatcagagttttgcagattcactcgactgatcgatgtgacatgagctacctcactagaatgtcattgttaaataaagtctcaaaatactgcatcaagtattcaggttatccttcacattccgtataaattcaaaactacagctagttcttgaactaacgcaccagttttgcttcttgtgttcagatttgactagtgtattaatgtgtgttaactcagatttaccatgaaatgtgaaatgtgtttgaagactcaccttggaagctatattgaacttctctttggttttggagtcaccaagcagctccagcagttacgtacgtatttaggaagcagaatacttccgcagctaaaactcattgtccacatttctcggaaaaataaaaacaaaacaaaacatagcagtgacttgtatctattgcttagactttaggcgtgaatcagagtggagttgggattaatgtatatttttaacacttacaagaaagcaggcttgagaaatttcacacagaatgataatacaagtcagagtcagtaccagggatgtgttattatgaagtcataaagaagaaattgagataatacaatatcttgttttatgtttttgcttgtatcaaaaatcatgcagaattaaaaccacaatagcaaaagcttttttttattattcttctatcttcttcatctttggtcaagaagacaagtaaaaaaaaaaagctggtaacttttgatacatgatagcctttggaggagatcaagcagttctcttaatgatatggactccactgtctgtatccacaatctcgcttatatcaccaaccttgagtgcgtatgttgcctcctcaaacggtttctgcatttgacctctcccaaacggacct

SEQ ID NO: 112 - DNA, 5750 bp, Raphanus sativus
  source 1..5750: /organism="Raphanus sativus" /mol_type="unassigned DNA"
caaattgctcaatattaatatttcttaatttttactatatttttctttagaaaatgtttataaaaattcgttaaagaatctatataatatttttaaatacactaaacatcatttgttttctatgactttaaaatgttgttatgtgcttggtctttctttgctttttcttccattactttcttttgaatcttgtactccatctatatataaacaacaacaaaaaaaaaattgtaaattggtgttgcaaataaaatattttgagttcaatcaaccagataaatcatttattttgatctgagttaatggttttcattgagtgacaagaatcaattgttcctttttaaatggaccaagattctcataactgaagattacatgcaaattacatagatctgagttaatggttttcatatgacgttaaaaagaataatataacacgatggatgataattatttcttctttttcatatttaaaataaaacaaaataaacacatatgtgattacttagatgatgacttgtctcgatagatgatgatttcaaagaaaaatggaaaattatataaaattaaaaaatatattaaaatctataataaatttcgtgataaaatcaacacaaatcataaaacacatatttattttaaacataatttattataatattattattaatttcgaataatatattaattactgaaatattgaattgatgttcatttaaacaacaaaggcatcagttgttcttaactgattttaaatatatatatatatatatatatatatttgtatcatttcaaaataagtaattcaaaatcatatcacttatttttgtgatgcaaattaagtgatacaattcaatggttttttatatgaatatggtattttttaaaaagcacaatttgatgtcggaagttaaaaacagagacacatcaacacatttctgcgatttcttcgtaatactaatacaaagtactttaaaaactagagtaagtaattacctctctgaacctagaacatatggacttacatagtatgtagcaccaaagatacaatctagatacaatactcagaaattgttttctttattcatcttttcaatataattatttaacggtttgataccaacgaatcatgctctatatttgcgtatattcatttgtttattgtatttaaactcagaaactgtactatcatgtatctgtcatgtaaatcttgagaaagctacatagttggttttacaaagcctaaccatgcacgttctttttcgtttgattatttccatacgttttttttttgttagattatttccatgtaatttattttttcttcagtactaaataaatataacacgtatactttgactggaaaatctacattcatatcatttacatattaaaaattccaaataaaattttaaatatttgtatataattctcgaacctttagagcagcctcattggctaatactgggtagaggatctcaacaattttattttaaatcaatacaatttatgttaagcaattaaaatcttttattcttttcaacaaaaaaaacaatgataacatgccatctaatgttaaagagttatcacaatatctctactgctataccatctcacaatctttctttctttttaataaattcatcgtgagaacctaatttttatctcgtttaagtcaaaaaaaaaatcttcatctcatcgatggaggtattcttagatctattgatctttattgtaaatctaatttctttcatcggtagattttctattcaaactacatatatattgttatccttattgggatatatattgattattgggatattgactattgacttgtgtttttttttaagaaaacaaatctttcattataccatacatatatctctaagtgctaataaatcgaatacagatacagccactttcatgtgtatacaaccatattaaaaacctcatcaccatctttttactctgtgtattgaaaagaaaaaacataaaagatggattgtttgctttgctcaccaattttatatgtagttcttatatttctttggtatttggttagagttttggtaactcgtggaaatccatttccacctggtccaaaaggctatccaataatcggtaacatgaaactaaagaatcagttgaatcatcgtggtttagccgagttggccaaacaatacggtggtcttctacaccttcaaatgggtaaaattcatattgtggccgcttcaacggctgagatggcccgtgaaattcttcaggtatgcgattttatacggtttagaaattgttttgatattttaagtattcttctaaacatttggataggataacaatgaatttctagtttttttgcaagacaacattcatttcaaacattgagttatgttaggttcaagatgtggttttcgcaaaccggccagctaacgtggcgatttcatatcttacctacaaccgggccgatatggcgtttgcgaactacggtcccctctggcgtcaaatgagaaaggtttgcgtaatgaagctgtttagcagaaaacgggccgaatcatgggcctcggttcgcgacgaaattaatacgatggttcaaactctgactaaacaaaccggttcaccggttaatgttggtgagcttgtatttgctttgacgcggaacataacgtaccgagccgcgtttgggtcgttcgctcgcgacggtcaagacgaattcgtcaagattctacaggagttctcaaaactctttggagcgtttgatatcactgagtttttaccgtggatgaaatggtttagtaaccgcgatttcagcaagcggttggaaaacgccaggaaatcgctggatgggttcatagacagaatcatcgatgcacatatcgagaagaagaactcaagaaaacaagaggatgatgggttggaggacgacatggtggatgaactaatggcgttttatagcggtgagaacggcggcaaatctaacgattccttgtctacatttagactcacgagagataacatcaaagcccttgtcatggtaactagctaatggaatataatttatacatacataaaccataggttaatgtcatattatatttattaatataaaatgatttaaaataggatgtgatgtttggcgggacggaaacggtggcgtctgcgattgaatgggccatgacggagctgatgaagaatcctcacgaactcgtaaagctgcagcaagagctcgctgacgtcatcggattgaaccgtcagtttcacgaatctgatctggagaatcttccttacttcaggtgcgcgatgaaagagacgttgaggctacaccctccgattcctcttctcctccacgaggcggcggcggattccgtcgtctccggctactccattccccgtgactctcgcgtcatgatcaacgtgtacgcgatcgggcgagacggatcggtatggactgaaccggatgcgttcagaccgggtcggtttatggaagacaaagctccggatttcaaaggtagtgacttcgagtttcttccgtttgggtcgggtcgaaggtcgtgcccgggtatgcagttggggctttatgctatggagctcgccgtcgcgcacatgctccattcatttgactggaagttgccggaaggagttagctctggtgatctggatatgaccgacatgtttggtctcacggcgcctagagccaccaggctcatcgctgttccgagctaccggctaaaatgtccgatggtgatttgaaattcgtgttgtttgatactgttttatttcaactgttcgctgttttcatgactccttatacaatgtgttgttgttttgtttttgttgaactgtttgctgtttcgtgatacaatgtgttgttgtggtttaatattccaatctgttttctcaattatccagaatctcggttgggattttcctatttttaaaagtaatttcatgatcatgtcaggagtcataacaaaagcataaatcaactctgcttctcctcagaacactaacttagcaaaagctacttagtacctaaaggggtagtgatggtggtggtggtggtggtggttcactaatctcccagaagggcattcataggcaatgtgtccccttccaccacagtttcgacatatcatcagcctagccctgcagtctctgctcatatgacccacttgccggcagttcctgcaaaccacctcctcctccctgatttgggctctgatccctcgtggtaacacatgggttttagggcatttgatagcaaggtgaccagacaggttacagtgattgcacacgggatcgtctctgcagtcacgagcaaaatgaccggtcttcctgcacttgttgcaggctttctcgttagtgcaatcagctgagaagtgaccttgcttgtaacagttgttgcagagtctaaggtcaccaggagggaggtggcgagccgtgcagtctttagcttggtgtccggcaataccgcagccgtgacaaatgccttcgttggtgcagctattagacatgtgacctggttcacggcagttccaacacagcgacttcgcggagcattctgataaaatgtgcctgccaagtatttttattagaaaaataaaataaaaagacagggatatattatcaagttattacattaatgtaccttgaagattagtgtataaaaaatgtagcaagaacttcagtataacaatctaaaaacaagttaaaacaacgtgatgcaaagagcgtaagattgagaagtagagagaaagaatagggtttacccaggaaggccacagttgtggcagatagagacattgggacactctcgagcaaaatgaccaggttgcttacaattcttgcacatattactttggctgttaatggtagccaaaggaagaagaagcatatcagttaagaaaaaaaaaccaatttgatttccttcttctaagagaaatgccaatttttcgatcttaatggagatgagagaaaaacctgaaagtccgacgagaatctctccggtaaggatcatcacggtaagaaaaacgatcagaagcaatctttctgtccatcggattcctaatcctctccaaactcattatcttagcaacaaaaaaaaaaaacaaaagagagggtatcattcaattgatgtgaataggagatgcaaagtgtgtctaaattgaaagaagcacggaacatcctcctccatccactctagaaaaaaaaaacatgaataatcacactccttaagatgcgcttaaaccctaacaacgattctcacaactaactaaacccaaaaattaaccaaactgcttttcttacaccgtcagtacctccttccttcacgtcgacgacaaccaatattttgacgacaaccaattttccgacaagtaaactgtcagcagttcgacaaatctggcgtgcggcgaaagaacctctgcgacacacatcctcttaacacgctcacaaaacaactcagcagttataaatgggctttaaaagcctttcgtgacccattaactaagcgagacacgcctgttatgtagtaacgaattacggttaagttcggtaatgcgtccacttgctcttttctgatacggtccagtctacaaatacgtacaaacatcaaatttgtaacatcatatgcatggcccatatcccatatgcaatctaaatttctaatgcctacaataaattaatttaacatcatatctgctcatcgtactttgtagtagtaaatataaaagacgatccaattactatca

SEQ ID NO: 113 - DNA, 6153 bp, Raphanus sativus
  source 1..6153: /organism="Raphanus sativus" /mol_type="unassigned DNA"
gtgcagcgtctgcgacaaggcgttttcttcttaccaagctctcggcgggcacaaggcgagtcaccggaaaaactcatcgcagactcagtctagcggaggagatgagaaatccacgtcctccgcggtaaccatcgctagccacggcggcggcggcggaggaggaattgtgaagcctcacgtctgcacgatctgtaacaagtctttcgcgacgggtcaagctctcggcggccacaaacggtgccattacgaaggcaaaaacggcggcgttgcaagcagtagcttgtccgtttccgaaggcgtggggtccacaagccacgtcagcagcggcagccatcatcaccaacaccaccaccgtgggtttgacctcaacatcccgccgataccggagttctcgacggtcaacggagaagaagaggtgatgagccccatgccgacgaccaagaaactgaggctcgagtagattcagctagcagtttaaatgaaatttgttatatactgtacatataccaatttttagattccggttcgtgttcttcttcattgaatcagtattccttctttgttatatttgtgtagttttcttgttttctttaagttgtcgcttaaagaaaaagaccctcaaacaattcaaatacgtttcagtttctaaaaaacacatattacaaccttacggcctgtttgttggtccgttggactagcttggtgggctcgtatgacttaacctacaagtctcagcccatgtaaagagattcgtttgaggtagataaactgaagtttccttgcagtataataacaaaatccacatacaagtaattcttttagaccttccttggttataagaacagtgcaaaatataagatgtatttttttcaaccatataatgatataagatgtatttgaaatcctttttttttgaacggcaacgtatttaaactccatacgtataaaatgttatttacattaccaaccaaaagcaccatctttttttaaggagccattccacaacctgacaaatattgacctacctacttagcaaaaaaaaataaaaattgacctaccatataattattatgcgtccaaagagcatacattattatgttatatataattgatatgtacgtcaatgtgataaaattggctaaacatccagtaagatcattggttggttttgtttatcatttttgttgaatatcatgtactcccacaaaagattttgcgtggatatccagctatacaacaatatacatagaggtaagacgtcctcattgcgaatgcgagacaaggcctctaccatcaaaactcaaaacgttaaagaaaaatccaacagtaacatcatactgacaatatattttaactttgataactatggtattaatataatcacagacatggttacagactaaatagaaatatgagatctctcttgaacaaaatattccacagctactgaaatttacgtagctcatttggtgtgtttgaccccttcttgacacccctttcatagacacacctggattccaaaaccccaaattgtaattttctgttacaaaaaaaaaatattctacagcttaattttaaatcgaagttcaatccacaacggattaaccactactgactactaagtttgctccactctgtttcgctctctaaagaatttttgtcgtctacctaatttagtagatagagtgagatgataatgcaaatatacacaatacatgccatacaagctacttacgcctgtcgttttcaccaaaaactatataataaaccctaatgatcgatcaccctgcacgttgtgacttctttaattgttctttgcaccaatcaatcaatcatggaccatggtcacatgaaacacattgataaagaccaatttcaataaaataacagcaaatgtacacaaaagaggtattagagttgaaatagttgttaagtcatatcaatcacattattttcttaacatatataaaatagacccacgcacactaactcgtatcaaaatgtatactccaatgactctcatccttctcgtccctcttctacttttcctttactggcacctcctttcacggcggctaaggttgcggaaatcataccctcccggcccaaaaggcttacctatcattggcaatatactcatgatgaaccaagtcaaccaccgtggcctggccaaactcagccgcacatacggcggattacttcacctccgtctcggactttcccatcttttcgtagtctcctctcctcaaatcgcacgtcaagtcctccaagttcaagaccacgttttctcgaaccgtccaaccacaatagcaatccgttacttgacctacggtcaatccgacttagcattcggcaattatggcccgttctggcgtaggatgagaaaactctacgtcatgatgctctttagccgtaaacgagctgagtcgtgggcctctgtcgacgaagaggtccacaaagcagtccgttttgtagcggccaatgtcggaaaaccactaaacatatgcaaagtcgctttctccttgacaagagatataacgttcggagcagcgttcggctcttcctcgtcaacttctgacgaaggcagactagatgagttccttgagatcatacaagagttctctaagctctttggtgagttcaacgtagcggattacgtcccgtcctggcttagttggatcgacccgcaagggataaacaagcgggtcgagagagctcgaaaatctctagactgtttcattgagtcaatcatcaatgatcatttagacaagaagaagacagaaaacaacgttgacgttgacgaggagaccgatatggttgaccagttacttgcgttctacaaagaagaagtcaaagtcaaggactcggagacaaaaatcaatctcaacaacataaagggcatcatcatggtaaaagctaaacatagtccattccatccgtttcaaatcatacaatcaaatttttaaaatagtagaatgtacaattttatttttatttaactattagaattatgtagcattttaaaaaagaattatgtagcatttattttttaaattttttaattagtgataaaagtgaacaattaataaaaacagcattaaatcatatttatttttaaaaaaatatttagaccgtaatttgatgaacaaaatttggaatatgaatgcatggaatagatcattccatttaactccttgaaaaatacactgttacaagaaaaatattattcataaagcattcctaaaattcttttggaatcaatggaaagagaataatttatttgtaaaatcattacacaacgtaatcggtaaggatcaagtggaatgaatggaatgcatcattttatttttaatttaattaataaatatattttatttctatttcattcctcttcattctatttaattacattcttttagttcataatattcccctaaatgatttccggttacacccttagtttatatatttgaaaagtttttgataacagaatgaaaatgaaatataggatgtgatgttcggaggaactgagacggtggcattagcaatcgagtgggtactaaccgagctactccggagccccgagaacatgaaacgggtccaggaggagctagcgactgtggtcgggcttgagcggtggagcgtagaggacacacaccttgagaagctcactttcctaaaatgtgtactcaaagagaccctccgactccacccgccgttccctctcctcctccacgagacggtggaggacgccgaggtctccggttactccattcccaagggatcacgtgtgatggtcaacacctacgctctcgggcgtaacccgaattcctggtccgacccagaaatatttaacccgagtaggttcttggacccaggtgctcctgatctcaaagggaacagtttcgagttcattccgttcgggtcgggtcggagatcgtgtccgggtatgcaactcgggttgtacgcttttgagcttgcggtggctcatctactacactgcttcacgtggaagttaccaaacggtgtgaaacccggtgatgtggacaccatcgaagggcctggtctcaccgttcctaaggcgaactctcttgtagcagtgccgaccacgcgcctcctctctcccatcgtcttggaaagccacaatgtttaaaaaacttgttttcataagcattgttttacgttgatattttctttcgttatgtatatattgtgttcgtgtttaagttggcatttttgttcgtaaaatgtatatccaaataaatacataaagcttcgaaaatgttttgttttttaaaagatactgacaccaagtagaaagacgaatacattttttcaactactatgtgatatatataataatatttcttaaagaaacaaattaactatgtattttaaataactgttgccaaaaacaggagaaaaataataggttacaaaaaaacaacacaggagaaaaaataataatataaccgatgcttaaatacataaacattacaaataaatggtttaaacataataatttttagttattgttgtaaagtagtcttataaaagggtaaacccccttttaaaatcactgttgcattaacgggcagaaatgaatgtaagtaacgttcacatgtaaaacagatataaacatgtaattcatagtttaattaagcaagatattgtcatcgagtcaaagggttgacttgtgatgtcggagaaacagagaattaaaagcagtacgagattgaatcacctagtggactaatctataatgcacacactaaattagaagtgtagatttattacacaatcgttttaagtagaagaggaagtcaaagagattaccagaaataaaaagaggaagtcgaagataacctttgatatacaaaagcatgaagtaagcttctgaacaacaatcttttgcatattaggagcccaagatgccaagaggagattcagcagtctcaccgcaatttcacctttacgtgagacttctccgtatgattggactttctctgatgcatgtctggatgttcttctcataattcctccggtgagaaaaatgcaagtggtcttagctaacttagacagagaaaaaaaaacaaaacagtatcatgtttcaacaaaccttgcatcatcagcactcaaggtttcagtcacttccggttcttgaaaatcaaacgtttccgtctgttgtctagcagagactctgcccatttatacaagaaattagtgacctctctaacgcattgttttagatggctattagatatttatctaataatgtcagattgtcacggctgaacaaaattgtttacatggtttgtggtttcagtttcccgagttgtaattaagggagtttcagagaattgtgatgtaactgcactaatcattcactatgtaattatgttgttgtgtttaatcatacctcaatgggtcatattgaaaggaataaaaaaaaaacaaaagataagatgatatttatccaccttcttcttagtcaacttcaacttcaggatagagatgtggatgctcaacatgcataaatgtctttctgctttgaaacacctcgagacagatcactgcaccacataaacaatggtaatcgatgatggtcacgaggggatgtcagaaacagtccaaaattgttggaaactctgccattctgcaaaaaagagaagagagtaacaatagagatatacatttgtaattacaacgaactcttatttttgaatgctaaacaacattaaatataaatataaaataatttaaaaaaataagaaacataaaaatataaaccaaatttcttgaaataaaactttaaatgaaagtcaaaactactcaaaatgaattaaaagtttcagaattgaattttacgaattcaaactgaaccaaaccagaattatatgaaaccaaaacaataaacatcacaagttgaaatgttaaatcatggttttggtattttaaataaaatgcacttgtttagtgagatattttactcttcgaatttcatttcaattgccatgtgccattatgtattgtaatttcaaatgtcattagtttccttgtcccactgtactcttctattgaattagttatcatgcattttcgaattattgaactctcgaattattgaactctgcttttgatcaatttacttgt

SEQ ID NO: 114 - DNA, 1825 bp, Allium cepa
  source 1..1825: /organism="Allium cepa" /mol_type="unassigned DNA"
actgggaatcaaagaaaaacaaagaagcagactccaacgagggaagctagattcaaacacaagaactcttcccctcgcatacacaaagctcaaagaaacaaaaccaaagccatgatggacatgcaatccatcctcatattcaccctcccattcgtcaccctcctcttcctggtcattaccagccgccgcaggcccaaactcccgcttccgcccggcccgcgcccactacccatcatcggcaacctcaacctcatcgacaaactcacccaccgtggcctggcccatctggccaaccaatacggtggcatcttccacctcaagcttgggtccgtccacaccttctccatctccacacccgaaatcgcaaaggaggtccttcaaacccaggacctggccttctccaaccgccccgccaccatcgccatcacctacctcacctacgaccgggccgacatggccttcacccactacggcccattctggcgccaaatccgcaaactctgcgttatgaagctgttcagtcgaaaaagagcggaatcatgggcctccgtccgagaggagatagagaaggctgtatcgaccgcagccgcgggcgctgggactgtggtcaacgtaggggagctggtgttcaatctgacgaagaatataacgttcagggcggcgtttggagcgaagtcgggcgaggagcaggatgagtttctggggattttgcaggagatatcaaagctgtttggagcgtttaatgtcggggatttcgtaccgggtttgaggtacttggatccacaggggatagggaggaggatgaggaaggtgaggaaggaactggatggatttattgacaggataatagatgagcatgtgcagaataggaaggaggtggatgatgtggaggccgacatggtggatgagatgttggcgtttgttggacaagggaagagcattggtagggattctgatgagttgaggcttactaggaataatatcaaggctattatcatggacgtaatgttcggaggaacagagacagtggcctcggcaatagaatgggcaatggcagagctccttaaaagcccagaagatctcaaaaggctccagcaagaactgacgtcggtagtgggcctggaccgcaaagtccaggactccgacctcgacaaactgccgtacctcaaatgcgtcatcaaggaaacgctgcgacttcatccaccgatcccgcttcttcttcacgaaacagcggaggactgcgagatccagggctactcgatccccaaaaaatcgagggtaatgatcaacgtgtgggcgatcgggcgcgacaagtccgcctggaaggacgcggaccagttcaagccgtcgagattcgtgaagggaggggagtacgagcaggtggattttaaggggaatttcttcgagctgctgccgtttggggcgggaaggaggtcgtgcccggggatgcagctggggctgtacgcgctggacctgacggtggcgaatatggcgcactgtttcgattgggagttgccggacgggatgaagccaggcgagatggatatgagcgacgtgtttgggttgactgcgcctagggctgtgaggcttgctgctgtgccttctcctagattgacttgtcgtatttgatttcaacatgtacatacgatttgtgtttatatatacgttataaagtatacacaacggtgattgtttgtataattgtaatgctgttccatggtgcggactaataaaaatgttcaatgagagggttttgaaagacgtatggtgtatgtgaattgtaaatttatataattgttacttcgtcattaatgaaactttttca

SEQ ID NO: 115 - DNA, 1521 bp, Lactuca sativa
  source 1..1521: /organism="Lactuca sativa" /mol_type="unassigned DNA"
atggaatcacttcaaatccccatagcattctacgctataatagctatcttaactttcttctttctttcatgggtccgccggaaaccactcccgccggggccaatggggtggccaatcatcggcaacatgttgatgatggaccaacttacccaccgtggcttagcccgtttggcagaaaaatacggtggtatccttcatctaaagatgggtttcagccacaccattgcagtgtcctcgccggagatggcgaggataatacttcaagaaaaagataacatctttgccaaccgtccggcaaccatcgccatcacttacctgacttacaacggcgtagatttggcttttgctaattatggacctttctggcgacaaatgcgaaagctttgtgtcatgaagctgttcagccggaaacgagcggagtcatgggactccgtcagggatgaggtggacaccatggtgaaagccaccgccattaactccggtacgccggtaaacttgggtgagcttgtttttgggttgacccatgatattatctaccgagcagcttttgggtcgatttcacatgaagggaaagaagagtttatcagaatccttcaagaatacaccaaactttttggcgcattcaatttggctgactttatcccgttcctcgggtttattgatccggcggggttgaacacacgtttaccggcggccagggcggcgttggacggattcattgacaaaatcatcgacgagcatttgcgtaaaggaaagaaaaccggcgatgaaggtttggataacgatatggttgatgagatgttggcgttttacagcgaggaaggaaaagtcaacgaaggtggtgatttgcaaaacgccattaaccttactcgagataacatcaaagccataatcatggatgtaatgttcggtggaactgagacagtggcgtccgccatagaatgggccatgacggagctaatgcatacaccggaggcactaaagcgcgtgcaacaggagatggcaaatgtcgtcggacttgaccggcgcgtggaggagtctgacttggagaagctgacgtacttcaaatgcgtcatcaaggaaaccctccgactacaccctccgatcccagttctcctccaccagtcttcggaggcgacagaagtttccggctaccatatacctaaaggaacacgtgtcatggtgaacgcgtatgctattaatcgtgataagaactcttgggaagatccggatacgtttaacccgtcacgttttttacaaaacggagctccggattttagaggaagcaactatgagtttctgccatttggttctggtcggaggtcgtgtccggggatgcaactagggttgtatgcgatggagatggcggtggcccaccttttgcattgtttcacgtgggaattgccggatggaatgaagccaagtgaaatcgacatgggtgatgtgtttggactcacagcaccaaaagcaataagattggtagcagtgccaactccgcgtttattatgcccattgtattga

SEQ ID NO: 116 - DNA, 1512 bp, Lactuca sativa
  source 1..1512: /organism="Lactuca sativa" /mol_type="unassigned DNA"
atggatcctaagtccatcttactttacgttgtactccctctcttaaccttcttccttctctcccgattacgccgaaaacctcttccgcctggtccaagagggtggccgctgatcggtaacatgttaatgatggaccaactcacccaccgtggccttgctcgtttgggagaaaaatacggtggtcttcttcatctgaagatgggtttcagccataccgtcgctgtctcgtcccccgaaatagccaggcaagtactccaagttcaagacaacatcttcgccaaccgcccggccaccatcgccattagttacctcacctacgaccggcaagacatggcgttcgccaactacggtcccttttggcgtcagatgcgtaagctttgcgtcatgaagctgttcagcagaaagcgagctgagtcttgggactccgtcagagacgaagttgtctccatggtcaaaatcaccgctgcaagctccggcaccgctgttaaccttggagagcttgttttcgggttaacccatgatatcatttaccgagcagctttcgggtctatctctcatgaaggaaaagaagaattcatcagaattctacaagaatacacaaagctttttggtgctttcaatttggcagattttgtcccgtggcttggatttatcgaccctgccggactgaatacccgtttaccgaaggccagggcggcgcttgacagattcattgataaaatcatcgacgagcaccttgcaaaagagaggaaaacgggcgatgaggaagataatgatatggtggatgagatgttggctttttacagtgaagaaggaaaggtaaacgaaggcgaggatttgcagaacgcgattagactcacccgaaacaatatcaaagccattattatggatgtaatgtttggtgggactgaaactgttgcttctgctatcgaatgggctttaactgagctaatgcacaccccagaatccttaaaacgtgcacaacaagagctcgctgatgttgttggccttgatcgtcgtgtagaagaatcagatttcgagaagctaacttacttcaaatgtgtcatcaaagaaaccttacgtctccaccctccgatccctgtccttttgcaccaatcatcagaagccacgtcggttgctggctaccacatacctaaagggacacgtgtcatggttaacgcattcgccattaatcgtgataagaactcatggaaggatccacacacgttcaacccatcacgtttcttgcaagatggggcacccgactttaaaggaagcaattatgagtttcttccatttggatctggacgtagatcatgtcctggaatgcaacttggattgtacgcaatggagatggcagtggctcaccttcttcattcattcacatggcagttgcctgatggaatgaaaccaagtgagattgacatgaatgatgtgtttggactcactgcaccaaaagcgattcgacttgttgctgtgccaactcctcggttgttgtgtccgctgtattga

SEQ ID NO: 117 - DNA, 101 bp, Lactuca sativa
  source 1..101: /organism="Lactuca sativa" /mol_type="unassigned DNA"
cttacaacggcgtagatttggcttttgctaattatggacctttctggcgataaatgcgaaagctttgtgtcatgaagctgttcagccggaaacgagcggag

SEQ ID NO: 118-123 - skipped (6 entries)

SEQ ID NO: 124 - DNA, 101 bp, Lactuca sativa
  source 1..101: /organism="Lactuca sativa" /mol_type="unassigned DNA"
tgagtcttgggactccgtcagagacgaagttgtctccatggtcaaaatcatcgctgcaagctccggcaccgctgttaaccttggagagcttgttttcgggt

SEQ ID NO: 125 - DNA, 101 bp, Lactuca sativa
  source 1..101: /organism="Lactuca sativa" /mol_type="unassigned DNA"
ctccatggtcaaaatcaccgctgcaagctccggcaccgctgttaaccttgaagagcttgttttcgggttaacccatgatatcatttaccgagcagctttcg

SEQ ID NO: 126 - DNA, 101 bp, Lactuca sativa
  source 1..101: /organism="Lactuca sativa" /mol_type="unassigned DNA"
caaagccattattatggatgtaatgtttggtgggactgaaactgttgcttttgctatcgaatgggctttaactgagctaatgcacaccccagaatccttaa

SEQ ID NO: 127 - DNA, 101 bp, Lactuca sativa
  source 1..101: /organism="Lactuca sativa" /mol_type="unassigned DNA"
agatggggcacccgactttaaaggaagcaattatgagtttcttccatttgaatctggacgtagatcatgtcctggaatgcaacttggattgtacgcaatgg

SEQ ID NO: 128 - DNA, 101 bp, Lactuca sativa
  source 1..101: /organism="Lactuca sativa" /mol_type="unassigned DNA"
ggcacccgactttaaaggaagcaattatgagtttcttccatttggatctgaacgtagatcatgtcctggaatgcaacttggattgtacgcaatggagatgg

SEQ ID NO: 129-142 - skipped (14 entries)

SEQ ID NO: 143 - DNA, 101 bp, Lactuca sativa
  source 1..101: /organism="Lactuca sativa" /mol_type="unassigned DNA"
cttacaacggcgtagatttggcttttgctaattatggacctttctggcgacaaatgcgaaagctttgtgtcatgaagctgttcagccggaaacgagcggag

SEQ ID NO: 144-149 - skipped (6 entries)

SEQ ID NO: 150 - DNA, 101 bp, Lactuca sativa
  source 1..101: /organism="Lactuca sativa" /mol_type="unassigned DNA"
tgagtcttgggactccgtcagagacgaagttgtctccatggtcaaaatcaccgctgcaagctccggcaccgctgttaaccttggagagcttgttttcgggt

SEQ ID NO: 151 - DNA, 101 bp, Lactuca sativa
  source 1..101: /organism="Lactuca sativa" /mol_type="unassigned DNA"
ctccatggtcaaaatcaccgctgcaagctccggcaccgctgttaaccttggagagcttgttttcgggttaacccatgatatcatttaccgagcagctttcg

SEQ ID NO: 152 - DNA, 101 bp, Lactuca sativa
  source 1..101: /organism="Lactuca sativa" /mol_type="unassigned DNA"
caaagccattattatggatgtaatgtttggtgggactgaaactgttgcttctgctatcgaatgggctttaactgagctaatgcacaccccagaatccttaa

SEQ ID NO: 153 - DNA, 101 bp, Lactuca sativa
  source 1..101: /organism="Lactuca sativa" /mol_type="unassigned DNA"
agatggggcacccgactttaaaggaagcaattatgagtttcttccatttggatctggacgtagatcatgtcctggaatgcaacttggattgtacgcaatgg

SEQ ID NO: 154 - DNA, 101 bp, Lactuca sativa
  source 1..101: /organism="Lactuca sativa" /mol_type="unassigned DNA"
ggcacccgactttaaaggaagcaattatgagtttcttccatttggatctggacgtagatcatgtcctggaatgcaacttggattgtacgcaatggagatgg

SEQ ID NO: 155-168 - skipped (14 entries)

SEQ ID NO: 169 - protein, 50 aa, Lactuca sativa
IFSNRPATIAISYLTYDRADMAFAHYGPFWRQMRKLCVMKLFSRKRAESW

SEQ ID NO: 170 - protein, 50 aa, Lactuca sativa
DFKGSNFEFIPFGSGRRSCPGMQLGLYALEMAVAHLLHCFTWELPDGMKP

SEQ ID NO: 171 - protein, 50 aa, Lactuca sativa
TRDNIKAIIMDVMFGGTETVASAIEWAMTELMHSPEDLKRVQQELADVVG

SEQ ID NO: 172 - protein, 50 aa, Lactuca sativa
YLKCCIKETLRLHPPIPLLLHETAEDCEVAGYHIPKGSRVMINAWAIGRD

SEQ ID NO: 173 - protein, 50 aa, Lactuca sativa
PYPPGPKGWPIIGNMLMMDQLTHRGLAKLAKQYGGICHLRMGFLHMVAVS

SEQ ID NO: 174 - DNA, 1521 bp, Lactuca sativa
  source 1..1521: /organism="Lactuca sativa" /mol_type="unassigned DNA"
atggaatcacttcaaatccccatagcattctacgctataatagctatcttaactttcttctttctttcatgggtccgccggaaaccactcccgccggggccaatggggtggccaatcatcggcaacatgttgatgatggaccaacttacccaccgtggcttagcccgtttggcagaaaaatacggtggtatccttcatctaaagatgggtttcagccacaccattgcagtgtcctcgccggagatggcgaggataatacttcaagaaaaagataacatctttgccaaccgtccggcaaccatcgccatcacttacctgacttacaacggcgtagatttggcttttgctaattatggacctttctggcgataaatgcgaaagctttgtgtcatgaagctgttcagccggaaacgagcggagtcatgggactccgtcagggatgaggtggacaccatggtgaaagccaccgccattaactccggtacgccggtaaacttgggtgagcttgtttttgggttgacccatgatattatctaccgagcagcttttgggtcgatttcacatgaagggaaagaagagtttatcagaatccttcaagaatacaccaaactttttggcgcattcaatttggctgactttatcccgttcctcgggtttattgatccggcggggttgaacacacgtttaccggcggccagggcggcgttggacggattcattgacaaaatcatcgacgagcatttgcgtaaaggaaagaaaaccggcgatgaaggtttggataacgatatggttgatgagatgttggcgttttacagcgaggaaggaaaagtcaacgaaggtggtgatttgcaaaacgccattaaccttactcgagataacatcaaagccataatcatggatgtaatgttcggtggaactgagacagtggcgtccgccatagaatgggccatgacggagctaatgcatacaccggaggcactaaagcgcgtgcaacaggagatggcaaatgtcgtcggacttgaccggcgcgtggaggagtctgacttggagaagctgacgtacttcaaatgcgtcatcaaggaaaccctccgactacaccctccgatcccagttctcctccaccagtcttcggaggcgacagaagtttccggctaccatatacctaaaggaacacgtgtcatggtgaacgcgtatgctattaatcgtgataagaactcttgggaagatccggatacgtttaacccgtcacgttttttacaaaacggagctccggattttagaggaagcaactatgagtttctgccatttggttctggtcggaggtcgtgtccggggatgcaactagggttgtatgcgatggagatggcggtggcccaccttttgcattgtttcacgtgggaattgccggatggaatgaagccaagtgaaatcgacatgggtgatgtgtttggactcacagcaccaaaagcaataagattggtagcagtgccaactccgcgtttattatgcccattgtattga

SEQ ID NO: 175 - DNA, 1512 bp, Lactuca sativa
  source 1..1512: /organism="Lactuca sativa" /mol_type="unassigned DNA"
atggatcctaagtccatcttactttacgttgtactccctctcttaaccttcttccttctctcccgattacgccgaaaacctcttccgcctggtccaagagggtggccgctgatcggtaacatgttaatgatggaccaactcacccaccgtggccttgctcgtttgggagaaaaatacggtggtcttcttcatctgaagatgggtttcagccataccgtcgctgtctcgtcccccgaaatagccaggcaagtactccaagttcaagacaacatcttcgccaaccgcccggccaccatcgccattagttacctcacctacgaccggcaagacatggcgttcgccaactacggtcccttttggcgtcagatgcgtaagctttgcgtcatgaagctgttcagcagaaagcgagctgagtcttgggactccgtcagagacgaagttgtctccatggtcaaaatcatcgctgcaagctccggcaccgctgttaaccttggagagcttgttttcgggttaacccatgatatcatttaccgagcagctttcgggtctatctctcatgaaggaaaagaagaattcatcagaattctacaagaatacacaaagctttttggtgctttcaatttggcagattttgtcccgtggcttggatttatcgaccctgccggactgaatacccgtttaccgaaggccagggcggcgcttgacagattcattgataaaatcatcgacgagcaccttgcaaaagagaggaaaacgggcgatgaggaagataatgatatggtggatgagatgttggctttttacagtgaagaaggaaaggtaaacgaaggcgaggatttgcagaacgcgattagactcacccgaaacaatatcaaagccattattatggatgtaatgtttggtgggactgaaactgttgcttctgctatcgaatgggctttaactgagctaatgcacaccccagaatccttaaaacgtgcacaacaagagctcgctgatgttgttggccttgatcgtcgtgtagaagaatcagatttcgagaagctaacttacttcaaatgtgtcatcaaagaaaccttacgtctccaccctccgatccctgtccttttgcaccaatcatcagaagccacgtcggttgctggctaccacatacctaaagggacacgtgtcatggttaacgcattcgccattaatcgtgataagaactcatggaaggatccacacacgttcaacccatcacgtttcttgcaagatggggcacccgactttaaaggaagcaattatgagtttcttccatttggatctggacgtagatcatgtcctggaatgcaacttggattgtacgcaatggagatggcagtggctcaccttcttcattcattcacatggcagttgcctgatggaatgaaaccaagtgagattgacatgaatgatgtgtttggactcactgcaccaaaagcgattcgacttgttgctgtgccaactcctcggttgttgtgtccgctgtattga

SEQ ID NO: 176 - DNA, 1512 bp, Lactuca sativa
  source 1..1512: /organism="Lactuca sativa" /mol_type="unassigned DNA"
atggatcctaagtccatcttactttacgttgtactccctctcttaaccttcttccttctctcccgattacgccgaaaacctcttccgcctggtccaagagggtggccgctgatcggtaacatgttaatgatggaccaactcacccaccgtggccttgctcgtttgggagaaaaatacggtggtcttcttcatctgaagatgggtttcagccataccgtcgctgtctcgtcccccgaaatagccaggcaagtactccaagttcaagacaacatcttcgccaaccgcccggccaccatcgccattagttacctcacctacgaccggcaagacatggcgttcgccaactacggtcccttttggcgtcagatgcgtaagctttgcgtcatgaagctgttcagcagaaagcgagctgagtcttgggactccgtcagagacgaagttgtctccatggtcaaaatcaccgctgcaagctccggcaccgctgttaaccttgaagagcttgttttcgggttaacccatgatatcatttaccgagcagctttcgggtctatctctcatgaaggaaaagaagaattcatcagaattctacaagaatacacaaagctttttggtgctttcaatttggcagattttgtcccgtggcttggatttatcgaccctgccggactgaatacccgtttaccgaaggccagggcggcgcttgacagattcattgataaaatcatcgacgagcaccttgcaaaagagaggaaaacgggcgatgaggaagataatgatatggtggatgagatgttggctttttacagtgaagaaggaaaggtaaacgaaggcgaggatttgcagaacgcgattagactcacccgaaacaatatcaaagccattattatggatgtaatgtttggtgggactgaaactgttgcttctgctatcgaatgggctttaactgagctaatgcacaccccagaatccttaaaacgtgcacaacaagagctcgctgatgttgttggccttgatcgtcgtgtagaagaatcagatttcgagaagctaacttacttcaaatgtgtcatcaaagaaaccttacgtctccaccctccgatccctgtccttttgcaccaatcatcagaagccacgtcggttgctggctaccacatacctaaagggacacgtgtcatggttaacgcattcgccattaatcgtgataagaactcatggaaggatccacacacgttcaacccatcacgtttcttgcaagatggggcacccgactttaaaggaagcaattatgagtttcttccatttggatctggacgtagatcatgtcctggaatgcaacttggattgtacgcaatggagatggcagtggctcaccttcttcattcattcacatggcagttgcctgatggaatgaaaccaagtgagattgacatgaatgatgtgtttggactcactgcaccaaaagcgattcgacttgttgctgtgccaactcctcggttgttgtgtccgctgtattga

SEQ ID NO: 177 - DNA, 1512 bp, Lactuca sativa
  source 1..1512: /organism="Lactuca sativa" /mol_type="unassigned DNA"
atggatcctaagtccatcttactttacgttgtactccctctcttaaccttcttccttctctcccgattacgccgaaaacctcttccgcctggtccaagagggtggccgctgatcggtaacatgttaatgatggaccaactcacccaccgtggccttgctcgtttgggagaaaaatacggtggtcttcttcatctgaagatgggtttcagccataccgtcgctgtctcgtcccccgaaatagccaggcaagtactccaagttcaagacaacatcttcgccaaccgcccggccaccatcgccattagttacctcacctacgaccggcaagacatggcgttcgccaactacggtcccttttggcgtcagatgcgtaagctttgcgtcatgaagctgttcagcagaaagcgagctgagtcttgggactccgtcagagacgaagttgtctccatggtcaaaatcaccgctgcaagctccggcaccgctgttaaccttggagagcttgttttcgggttaacccatgatatcatttaccgagcagctttcgggtctatctctcatgaaggaaaagaagaattcatcagaattctacaagaatacacaaagctttttggtgctttcaatttggcagattttgtcccgtggcttggatttatcgaccctgccggactgaatacccgtttaccgaaggccagggcggcgcttgacagattcattgataaaatcatcgacgagcaccttgcaaaagagaggaaaacgggcgatgaggaagataatgatatggtggatgagatgttggctttttacagtgaagaaggaaaggtaaacgaaggcgaggatttgcagaacgcgattagactcacccgaaacaatatcaaagccattattatggatgtaatgtttggtgggactgaaactgttgcttttgctatcgaatgggctttaactgagctaatgcacaccccagaatccttaaaacgtgcacaacaagagctcgctgatgttgttggccttgatcgtcgtgtagaagaatcagatttcgagaagctaacttacttcaaatgtgtcatcaaagaaaccttacgtctccaccctccgatccctgtccttttgcaccaatcatcagaagccacgtcggttgctggctaccacatacctaaagggacacgtgtcatggttaacgcattcgccattaatcgtgataagaactcatggaaggatccacacacgttcaacccatcacgtttcttgcaagatggggcacccgactttaaaggaagcaattatgagtttcttccatttggatctggacgtagatcatgtcctggaatgcaacttggattgtacgcaatggagatggcagtggctcaccttcttcattcattcacatggcagttgcctgatggaatgaaaccaagtgagattgacatgaatgatgtgtttggactcactgcaccaaaagcgattcgacttgttgctgtgccaactcctcggttgttgtgtccgctgtattga

SEQ ID NO: 178 - DNA, 1512 bp, Lactuca sativa
  source 1..1512: /organism="Lactuca sativa" /mol_type="unassigned DNA"
atggatcctaagtccatcttactttacgttgtactccctctcttaaccttcttccttctctcccgattacgccgaaaacctcttccgcctggtccaagagggtggccgctgatcggtaacatgttaatgatggaccaactcacccaccgtggccttgctcgtttgggagaaaaatacggtggtcttcttcatctgaagatgggtttcagccataccgtcgctgtctcgtcccccgaaatagccaggcaagtactccaagttcaagacaacatcttcgccaaccgcccggccaccatcgccattagttacctcacctacgaccggcaagacatggcgttcgccaactacggtcccttttggcgtcagatgcgtaagctttgcgtcatgaagctgttcagcagaaagcgagctgagtcttgggactccgtcagagacgaagttgtctccatggtcaaaatcaccgctgcaagctccggcaccgctgttaaccttggagagcttgttttcgggttaacccatgatatcatttaccgagcagctttcgggtctatctctcatgaaggaaaagaagaattcatcagaattctacaagaatacacaaagctttttggtgctttcaatttggcagattttgtcccgtggcttggatttatcgaccctgccggactgaatacccgtttaccgaaggccagggcggcgcttgacagattcattgataaaatcatcgacgagcaccttgcaaaagagaggaaaacgggcgatgaggaagataatgatatggtggatgagatgttggctttttacagtgaagaaggaaaggtaaacgaaggcgaggatttgcagaacgcgattagactcacccgaaacaatatcaaagccattattatggatgtaatgtttggtgggactgaaactgttgcttctgctatcgaatgggctttaactgagctaatgcacaccccagaatccttaaaacgtgcacaacaagagctcgctgatgttgttggccttgatcgtcgtgtagaagaatcagatttcgagaagctaacttacttcaaatgtgtcatcaaagaaaccttacgtctccaccctccgatccctgtccttttgcaccaatcatcagaagccacgtcggttgctggctaccacatacctaaagggacacgtgtcatggttaacgcattcgccattaatcgtgataagaactcatggaaggatccacacacgttcaacccatcacgtttcttgcaagatggggcacccgactttaaaggaagcaattatgagtttcttccatttgaatctggacgtagatcatgtcctggaatgcaacttggattgtacgcaatggagatggcagtggctcaccttcttcattcattcacatggcagttgcctgatggaatgaaaccaagtgagattgacatgaatgatgtgtttggactcactgcaccaaaagcgattcgacttgttgctgtgccaactcctcggttgttgtgtccgctgtattga

SEQ ID NO: 179 - DNA, 1512 bp, Lactuca sativa
  source 1..1512: /organism="Lactuca sativa" /mol_type="unassigned DNA"
atggatcctaagtccatcttactttacgttgtactccctctcttaaccttcttccttctctcccgattacgccgaaaacctcttccgcctggtccaagagggtggccgctgatcggtaacatgttaatgatggaccaactcacccaccgtggccttgctcgtttgggagaaaaatacggtggtcttcttcatctgaagatgggtttcagccataccgtcgctgtctcgtcccccgaaatagccaggcaagtactccaagttcaagacaacatcttcgccaaccgcccggccaccatcgccattagttacctcacctacgaccggcaagacatggcgttcgccaactacggtcccttttggcgtcagatgcgtaagctttgcgtcatgaagctgttcagcagaaagcgagctgagtcttgggactccgtcagagacgaagttgtctccatggtcaaaatcaccgctgcaagctccggcaccgctgttaaccttggagagcttgttttcgggttaacccatgatatcatttaccgagcagctttcgggtctatctctcatgaaggaaaagaagaattcatcagaattctacaagaatacacaaagctttttggtgctttcaatttggcagattttgtcccgtggcttggatttatcgaccctgccggactgaatacccgtttaccgaaggccagggcggcgcttgacagattcattgataaaatcatcgacgagcaccttgcaaaagagaggaaaacgggcgatgaggaagataatgatatggtggatgagatgttggctttttacagtgaagaaggaaaggtaaacgaaggcgaggatttgcagaacgcgattagactcacccgaaacaatatcaaagccattattatggatgtaatgtttggtgggactgaaactgttgcttctgctatcgaatgggctttaactgagctaatgcacaccccagaatccttaaaacgtgcacaacaagagctcgctgatgttgttggccttgatcgtcgtgtagaagaatcagatttcgagaagctaacttacttcaaatgtgtcatcaaagaaaccttacgtctccaccctccgatccctgtccttttgcaccaatcatcagaagccacgtcggttgctggctaccacatacctaaagggacacgtgtcatggttaacgcattcgccattaatcgtgataagaactcatggaaggatccacacacgttcaacccatcacgtttcttgcaagatggggcacccgactttaaaggaagcaattatgagtttcttccatttggatctgaacgtagatcatgtcctggaatgcaacttggattgtacgcaatggagatggcagtggctcaccttcttcattcattcacatggcagttgcctgatggaatgaaaccaagtgagattgacatgaatgatgtgtttggactcactgcaccaaaagcgattcgacttgttgctgtgccaactcctcggttgttgtgtccgctgtattga

What is claimed is:

1. A non-naturally occurring *Lactuca sativa* plant comprising
homozygously a modified ferulate 5 hydroxylase 1 gene (F5H1) and
a modified ferulate 5 hydroxylase 2 gene (F5H2), wherein
the modified F5H1 comprises a C>T mutation at position 370 with reference to SEQ ID NO: 115,
or
the modified F5H1 when expressed results in a modified ferulate 5 hydroxylase 1 that terminates at position 124, with reference to SEQ ID NO: 1,
and
the modified F5H2 comprises:
a C>T mutation at position 461,
a G>A mutation at position 494,
a C>T mutation at position 923,
a G>A mutation at position 1301, or
a G>A mutation at position 1307,
with reference to SEQ ID NO: 116,
or
the modified F5H2 when expressed results in a modified ferulate 5 hydroxylase 2 comprising:
a Thr>Ile mutation at position 154,
a Gly>Glu mutation at position 165,
a Ser>Phe mutation at position 308,
a Gly>Glu mutation at position 434, or
a Gly>Glu mutation at position 436,
with reference to SEQ ID NO: 2,
and wherein
the non-naturally occurring *Lactuca sativa* plant exhibits reduced wound-induced discoloration in comparison with a *Lactuca sativa* plant not having the mutations, and reduced wound-induced discoloration in comparison with a *Lactuca sativa* plant having only the mutation in F5H1.

2. The non-naturally occurring *Lactuca sativa* plant of claim 1, wherein the modified F5H2 is homozygously present.

3. The non-naturally occurring *Lactuca sativa* plant of claim 1, wherein the modified F5H2 comprises the C>T mutation at position 461, or the F5H2 when expressed results in the modified ferulate 5 hydroxylase 2 comprising the Thr>Ile mutation at position 154.

4. The non-naturally occurring *Lactuca sativa* plant of claim 1, wherein the modified F5H2 comprises the G>A mutation at position 494, or the modified F5H2 when expressed results in the modified ferulate 5 hydroxylase 2 comprising the Gly>Glu mutation at position 165.

5. The non-naturally occurring *Lactuca sativa* plant of claim 1, wherein the modified F5H2 comprises the C>T mutation at position 923, or the modified F5H2 when expressed results in the modified ferulate 5 hydroxylase 2 comprising the Ser>Phe mutation at position 308.

6. The non-naturally occurring *Lactuca sativa* plant of claim 1, wherein the modified F5H2 comprises the G>A mutation at position 1301, or the modified F5H2 when expressed results in the modified ferulate 5 hydroxylase 2 comprising the Gly>Glu mutation at position 434.

7. The non-naturally occurring *Lactuca sativa* plant of claim 1, wherein the modified F5H2 comprises the G>A mutation at position 1307, or the modified F5H2 when expressed results in the modified ferulate 5 hydroxylase 2 comprising the Gly>Glu mutation at position 436.

8. A part of the non-naturally occurring *Lactuca sativa* plant of claim 1 comprising a leaf, a whole head, a stem or a root.

9. The part of the non-naturally occurring *Lactuca sativa* plant of claim 8 comprising a leaf or a whole head.

10. The part of the non-naturally occurring *Lactuca sativa* plant of claim 9 wherein the leaf or whole head is processed.

11. A food product comprising the non-naturally occurring *Lactuca sativa* plant part of claim 9.

12. A food product comprising the non-naturally occurring *Lactuca sativa* plant part of claim 10.

13. A non-naturally occurring *Lactuca sativa* seed of the non-naturally occurring *Lactuca sativa* plant of claim 1, comprising
homozygously the modified F5H1 and
the modified F5H2.

14. A non-naturally occurring *Lactuca sativa* seed comprising
homozygously a modified ferulate 5 hydroxylase 1 gene (F5H1) and
a modified ferulate 5 hydroxylase gene F5H2 wherein
the modified F5H1 comprises a C>T mutation at position 370 with reference SEQ ID NO: 115,
or
the modified F5H1 when expressed results in a modified ferulate 5 hydroxylase 1 that terminates at position 124, with reference to SEQ ID NO: 1,
and
the modified F5H2 comprises:
a C>T mutation at position 461,
a G>A mutation at position 494,
a C>T mutation at position 923,
a G>A mutation at position 1301, or
a G>A mutation at position 1307,
with reference to SEQ ID NO: 116,
or
the modified F5H2 when expressed results in a modified ferulate 5 hydroxylase 2 comprising:
a Thr>Ile mutation at position 154,
a Gly>Glu mutation at position 165,
a Ser>Phe mutation at position 308,
a Gly>Glu mutation at position 434, or
a Gly>Glu mutation at position 436,
with reference to SEQ ID NO: 2,
and wherein
the non-naturally occurring *Lactuca sativa* seed is capable of growing into a non-naturally occurring *Lactuca sativa* plant that exhibits reduced wound-induced discoloration in comparison with a *Lactuca sativa* plant not having the mutations, and reduced wound-induced discoloration in comparison with a *Lactuca sativa* plant having only the mutation in F5H1.

15. A propagation material from the non-naturally occurring *Lactuca sativa* plant of claim 1 comprising a microspore, pollen, ovary, ovule, embryo, embryo sac, egg cell, cutting, root, root tip, hypocotyl, cotyledon, stem, leaf, flower, anther, seed, meristematic cell, protoplast, a cell, or a tissue culture, wherein the propagation material is capable of growing into the plant.

16. A method of producing non-naturally occurring *Lactuca sativa* seed comprising crossing a first parent *Lactuca sativa* plant with a second parent *Lactuca sativa* plant and harvesting the resultant *Lactuca sativa* plant seed, wherein said first *Lactuca sativa* parent plant and/or said second *Lactuca sativa* parent plant comprises the non-naturally occurring *Lactuca sativa* plant of claim 1.

17. The non-naturally occurring *Lactuca sativa* seed of claim 14, wherein the modified F5H2 is homozygously present.

18. The non-naturally occurring *Lactuca sativa* plant of claim 1, wherein said plant is grown from seed deposited with NCIMB under accession number NCIMB 42547, or NCIMB 42548, or NCIMB 42549, or NCIMB 42550, or NCIMB 42551.

19. The non-naturally occurring *Lactuca sativa* seed of claim 14, wherein said seed has been deposited with NCIMB under accession number NCIMB 42547, or NCIMB 42548, or NCIMB 42549, or NCIMB 42550, or NCIMB 42551.

20. A progeny plant of the non-naturally occurring *Lactuca sativa* plant of claim 1, wherein said progeny plant homozygously comprises the F5H1 mutation and comprises the F5H2 mutation.

21. The non-naturally occurring *Lactuca sativa* seed of claim 14, wherein the modified F5H2 comprises the C>T mutation at position 461, or the modified F5H2 when expressed results in the modified ferulate 5 hydroxylase 2 comprising the Thr>Ile mutation at position 154.

22. The non-naturally occurring *Lactuca sativa* seed of claim 14, wherein the modified F5H2 comprises the G>A mutation at position 494, or the modified F5H2 when expressed results in the modified ferulate 5 hydroxylase 2 comprising the Gly>Glu mutation at position 165.

23. The non-naturally occurring *Lactuca sativa* seed of claim 14, wherein the modified F5H2 comprises the C>T mutation at position 923, or the modified F5H2 when expressed results in the modified ferulate 5 hydroxylase 2 comprising the Ser>Phe mutation at position 308.

24. The non-naturally occurring *Lactuca sativa* seed of claim 14, wherein the modified F5H2 comprises the G>A mutation at position 1301, or the modified F5H2 when expressed results in the modified ferulate 5 hydroxylase 2 comprising the Gly>Glu mutation at position 434.

25. The non-naturally occurring *Lactuca sativa* seed of claim 14, wherein the modified F5H2 comprises the G>A mutation at position 1307, or the modified F5H2 when expressed results in the modified ferulate 5 hydroxylase 2 comprising the Gly>Glu mutation at position 436.

* * * * *

UNITED STATES PATENT AND TRADEMARK OFFICE
CERTIFICATE OF CORRECTION

PATENT NO. : 10,731,174 B2
APPLICATION NO. : 16/106684
DATED : August 4, 2020
INVENTOR(S) : Cornelis Maria Petrus Van Dun et al.

Page 1 of 1

It is certified that error appears in the above-identified patent and that said Letters Patent is hereby corrected as shown below:

In the Claims

Claim 3, at Column 231, Line 42, should read:
mutation at position 461, or the modified F5H2 when expressed Claim 14, at Column 232, Line 19, should read:
a modified ferulate 5 hydroxylase 2 gene F5H2 wherein Signed and Sealed this
Fifteenth Day of June, 2021

Drew Hirshfeld
*Performing the Functions and Duties of the
Under Secretary of Commerce for Intellectual Property and
Director of the United States Patent and Trademark Office*